(12) United States Patent
Olsson et al.

(10) Patent No.: US 10,364,450 B2
(45) Date of Patent: Jul. 30, 2019

(54) PRODUCTION OF STEVIOL GLYCOSIDE IN RECOMBINANT HOSTS

(71) Applicant: EVOLVA SA, Reinach (CH)

(72) Inventors: Kim Olsson, Frederiksberg (DK); Ernesto Simon, Copenhagen (DK); Michael Dalgaard Mikkelsen, Vaerlose (DK); Simon Carlsen, Reinach (DK); Veronique Douchin, Frederiksberg (DK); Swee Chuang Lim, Vallensbaek Strand (DK); Louis During, Copenhagen (DK)

(73) Assignee: EVOLVA SA, Reinach (CH)

( * ) Notice: Subject to any disclaimer, the term of this patent is extended or adjusted under 35 U.S.C. 154(b) by 0 days.

(21) Appl. No.: 15/541,686

(22) PCT Filed: Jan. 29, 2016

(86) PCT No.: PCT/EP2016/052007
§ 371 (c)(1),
(2) Date: Jul. 5, 2017

(87) PCT Pub. No.: WO2016/120486
PCT Pub. Date: Aug. 4, 2016

(65) Prior Publication Data
US 2017/0369922 A1 Dec. 28, 2017

Related U.S. Application Data

(60) Provisional application No. 62/110,207, filed on Jan. 30, 2015.

(51) Int. Cl.
| | | |
|---|---|---|
| *C12N 9/04* | (2006.01) | |
| *C12P 19/56* | (2006.01) | |
| *C12N 9/10* | (2006.01) | |
| *C12P 15/00* | (2006.01) | |
| *C07H 15/256* | (2006.01) | |

(52) U.S. Cl.
CPC ............ *C12P 19/56* (2013.01); *C07H 15/256* (2013.01); *C12N 9/1051* (2013.01); *C12P 15/00* (2013.01); *C12Y 204/01* (2013.01)

(58) Field of Classification Search
CPC ...... C12N 9/1051; C12Y 204/01; C12P 15/00
USPC .................................. 435/190, 252.3, 254.1
See application file for complete search history.

(56) References Cited

U.S. PATENT DOCUMENTS

| | | | |
|---|---|---|---|
| 4,590,160 A | 5/1986 | Nishihashi et al. | |
| 5,204,253 A | 4/1993 | Sanford et al. | |
| 5,306,862 A | 4/1994 | Chappell et al. | |
| 5,460,949 A | 10/1995 | Saunders et al. | |
| 5,538,880 A | 7/1996 | Lundquist et al. | |
| 6,013,863 A | 1/2000 | Lundquist et al. | |
| 6,215,051 B1 | 4/2001 | Yu et al. | |
| 6,255,557 B1 | 7/2001 | Brandle | |
| 6,284,493 B1 | 9/2001 | Roth | |
| 6,284,506 B1 | 9/2001 | Hoshino et al. | |
| 6,329,571 B1 | 12/2001 | Hiei | |
| 6,586,202 B2 | 7/2003 | Hoshino et al. | |
| 6,660,507 B2 | 12/2003 | Cheng et al. | |
| 6,806,076 B1 | 10/2004 | Miyake et al. | |
| 6,969,595 B2 | 11/2005 | Brzostowicz et al. | |
| 7,034,140 B2 | 4/2006 | Bramucci et al. | |
| 7,056,717 B2 | 6/2006 | Cheng et al. | |
| 7,098,000 B2 | 8/2006 | Cheng et al. | |
| 7,129,392 B2 | 10/2006 | Hahn et al. | |
| 7,132,268 B2 | 11/2006 | Miyake et al. | |
| 7,172,886 B2 | 2/2007 | Keasling et al. | |
| 7,183,089 B2 | 2/2007 | Keasling et al. | |
| 7,186,891 B1 | 3/2007 | Chappell et al. | |
| 7,208,298 B2 | 4/2007 | Miyake et al. | |
| 7,335,815 B2 | 2/2008 | Boronat et al. | |
| 7,364,885 B2 | 4/2008 | Miyake et al. | |
| 7,422,884 B2 | 9/2008 | Bai et al. | |
| 7,514,597 B2 | 4/2009 | Nakamura et al. | |
| 7,569,389 B2 | 9/2009 | Feldmann et al. | |
| 7,692,065 B2 | 4/2010 | Harper et al. | |
| 7,838,287 B2 | 11/2010 | Goldsmith et al. | |
| 7,923,541 B2 | 4/2011 | Yang et al. | |
| 7,927,851 B2 | 4/2011 | Brandle et al. | |
| 9,562,251 B2 | 2/2017 | Kishore et al. | |
| 10,017,804 B2 * | 7/2018 | Simon .................. C07K 14/395 |
| 2002/0142408 A1 | 10/2002 | DiCosimo et al. | |
| 2003/0033626 A1 | 2/2003 | Hahn et al. | |
| 2003/0148416 A1 | 8/2003 | Berry et al. | |
| 2003/0148479 A1 | 8/2003 | Keasling et al. | |
| 2003/0190734 A1 | 10/2003 | Hoshino et al. | |
| 2003/0219798 A1 | 11/2003 | Gokarn et al. | |
| 2004/0010815 A1 | 1/2004 | Lange et al. | |
| 2004/0072311 A1 | 4/2004 | DiCosimo et al. | |
| 2004/0078846 A1 | 4/2004 | Desouza et al. | |
| 2004/0176570 A1 | 9/2004 | Bacher et al. | |
| 2004/0194162 A1 | 9/2004 | Hahn et al. | |
| 2005/0003474 A1 | 1/2005 | Desouza | |
| 2005/0032169 A1 | 2/2005 | Miyake et al. | |
| 2006/0014264 A1 | 1/2006 | Sauer | |
| 2006/0079476 A1 | 4/2006 | Keasling et al. | |
| 2006/0083838 A1 | 4/2006 | Jackson et al. | |

(Continued)

FOREIGN PATENT DOCUMENTS

| | | |
|---|---|---|
| CN | 101720910 | 6/2010 |
| CN | 102216313 | 10/2011 |

(Continued)

OTHER PUBLICATIONS

Liu et al., "Biosynthesis of Rebaudioside A by Whole Cell of Recombinant *Saccharomyces cerevisiae*," Food and Fermentation Industries, 38(7) : 6-10 (2012) (Abstract translation).

(Continued)

*Primary Examiner* — Tekchand Saidha
(74) *Attorney, Agent, or Firm* — McDonnell Boehnen Hulbert & Berghoff LLP

(57) ABSTRACT

The invention relates to recombinant microorganisms and methods for producing steviol glycosides, glycosylated ent-kaurenol, and glycosylated ent-kaurenoic acid.

36 Claims, 70 Drawing Sheets
Specification includes a Sequence Listing.

(56) References Cited

U.S. PATENT DOCUMENTS

| | | |
|---|---|---|
| 2007/0004000 A1 | 1/2007 | Miyake et al. |
| 2007/0077616 A1 | 4/2007 | Keasling et al. |
| 2007/0099261 A1 | 5/2007 | Keasling et al. |
| 2007/0118916 A1 | 5/2007 | Puzio et al. |
| 2007/0128311 A1 | 6/2007 | Prakash et al. |
| 2007/0166782 A1 | 7/2007 | Keasling et al. |
| 2007/0202579 A1 | 8/2007 | Berry et al. |
| 2007/0238157 A1 | 10/2007 | Millis et al. |
| 2007/0238159 A1 | 10/2007 | Millis et al. |
| 2007/0238160 A1 | 10/2007 | Millis et al. |
| 2007/0254354 A1 | 11/2007 | Millis et al. |
| 2007/0269857 A1 | 11/2007 | Miyake et al. |
| 2007/0286850 A1 | 12/2007 | Bai et al. |
| 2008/0064063 A1 | 3/2008 | Brandle |
| 2008/0081358 A1 | 4/2008 | Vittanen et al. |
| 2008/0131926 A1 | 6/2008 | Miyake et al. |
| 2008/0261280 A1 | 10/2008 | Hahn et al. |
| 2008/0271205 A1 | 10/2008 | Yamaguchi et al. |
| 2008/0286870 A1 | 11/2008 | Vittanen et al. |
| 2008/0292775 A1 | 11/2008 | Prakash et al. |
| 2008/0318227 A1 | 12/2008 | Bacher et al. |
| 2009/0004724 A1 | 1/2009 | Keasling et al. |
| 2009/0047718 A1 | 2/2009 | Blaschek et al. |
| 2009/0055974 A1 | 2/2009 | Tanksley et al. |
| 2009/0074935 A1 | 3/2009 | Lee |
| 2009/0286262 A1 | 11/2009 | Slack |
| 2010/0112156 A1 | 5/2010 | Abelyan et al. |
| 2010/0120096 A1 | 5/2010 | Kitaoka et al. |
| 2010/0221801 A1 | 9/2010 | Van Dyk |
| 2010/0297722 A1 | 11/2010 | Anterola et al. |
| 2010/0316782 A1 | 12/2010 | Shi et al. |
| 2011/0087011 A1 | 4/2011 | Chiang et al. |
| 2011/0092684 A1 | 4/2011 | Abelyan et al. |
| 2011/0126318 A1 | 5/2011 | Allen et al. |
| 2011/0160311 A1 | 6/2011 | Prakash et al. |
| 2012/0021111 A1 | 1/2012 | Pfister et al. |
| 2012/0083593 A1 | 4/2012 | Liu et al. |
| 2012/0164678 A1 | 6/2012 | Stephanopoulos et al. |
| 2012/0178169 A1 | 7/2012 | Voytas et al. |
| 2013/0137138 A1 | 5/2013 | Hansen |
| 2014/0329281 A1 | 11/2014 | Houghton-Larsen et al. |
| 2015/0159188 A1 | 6/2015 | Ono et al. |
| 2015/0342234 A1 | 12/2015 | Hicks et al. |
| 2015/0361476 A1* | 12/2015 | Simon .................. C07K 14/395 435/78 |

FOREIGN PATENT DOCUMENTS

| | | |
|---|---|---|
| CN | 103397064 | 11/2013 |
| CN | 104845990 | 8/2015 |
| EP | 0955363 | 11/1999 |
| EP | 1072683 | 1/2001 |
| EP | 1171610 | 4/2007 |
| EP | 1198575 | 9/2007 |
| EP | 1383864 | 1/2008 |
| EP | 1897951 | 3/2008 |
| EP | 1947189 | 7/2008 |
| EP | 1392824 | 8/2008 |
| EP | 2902410 | 8/2015 |
| JP | 59101408 | 6/1984 |
| JP | 3-277275 | 12/1991 |
| JP | 05-115298 | 5/1993 |
| JP | 2009034080 | 2/2009 |
| KR | 2015 0000258 | 1/2015 |
| WO | WO 1999/018224 | 4/1999 |
| WO | WO 2000/036081 | 6/2000 |
| WO | WO 2000/037663 | 6/2000 |
| WO | WO 2000/063400 | 10/2000 |
| WO | WO 2001/012828 | 2/2001 |
| WO | WO 2001/083769 | 11/2001 |
| WO | WO 2001/094561 | 12/2001 |
| WO | 2002/024865 | 3/2002 |
| WO | WO 2002/020728 | 3/2002 |
| WO | WO 2002/020815 | 3/2002 |
| WO | WO 2002/055709 | 7/2002 |
| WO | WO 2003/008540 | 1/2003 |
| WO | WO 2004/029255 | 4/2004 |
| WO | WO 2005/079183 | 9/2005 |
| WO | WO 2006/016395 | 2/2006 |
| WO | WO 2006/093289 | 9/2006 |
| WO | WO 2006/096392 | 9/2006 |
| WO | WO 2007/136847 | 11/2007 |
| WO | WO 2008/008256 | 1/2008 |
| WO | WO 2008/034648 | 3/2008 |
| WO | WO 2008/039499 | 4/2008 |
| WO | WO 2008/051349 | 5/2008 |
| WO | WO 2008/091547 | 7/2008 |
| WO | WO 2009/005704 | 1/2009 |
| WO | WO 2009/071277 | 6/2009 |
| WO | WO 2009/086049 | 7/2009 |
| WO | WO 2009/105612 | 8/2009 |
| WO | WO 2009/108680 | 9/2009 |
| WO | 2009/140394 | 11/2009 |
| WO | WO 2009/140394 | 11/2009 |
| WO | WO 2010/021001 | 2/2010 |
| WO | WO 2010/038911 | 4/2010 |
| WO | 2010/142305 | 12/2010 |
| WO | WO 2010/146463 | 12/2010 |
| WO | WO 2011/028671 | 3/2011 |
| WO | WO 2011/037959 | 3/2011 |
| WO | WO 2011/046423 | 4/2011 |
| WO | WO 2011/056834 | 5/2011 |
| WO | WO 2011/153378 | 8/2011 |
| WO | 2011/140329 | 11/2011 |
| WO | 2011/151326 | 12/2011 |
| WO | 2011/153378 | 12/2011 |
| WO | WO 2011/151326 | 12/2011 |
| WO | WO 2011/153144 | 12/2011 |
| WO | WO-2011153378 A1 * | 12/2011 ......... C12N 15/8243 |
| WO | WO 2012/075030 | 6/2012 |
| WO | 2013/022989 | 2/2013 |
| WO | WO 2013/019050 | 2/2013 |
| WO | WO 2013/022989 | 2/2013 |
| WO | WO 2013/076577 | 5/2013 |
| WO | WO 2013/096420 | 6/2013 |
| WO | WO 2013/102793 | 7/2013 |
| WO | WO 2013/110673 | 8/2013 |
| WO | WO 2013/176738 | 11/2013 |
| WO | WO 2014/086890 | 6/2014 |
| WO | WO 2014/122227 | 8/2014 |
| WO | WO 2014/122328 | 8/2014 |
| WO | 2014/191580 | 12/2014 |
| WO | 2014/191581 | 12/2014 |
| WO | 2015/011209 | 1/2015 |
| WO | WO 2015/007748 | 1/2015 |
| WO | 2015/014959 | 2/2015 |
| WO | 2015/016393 | 2/2015 |
| WO | WO 2015/014969 | 2/2015 |
| WO | WO 2015/028324 | 3/2015 |
| WO | WO 2015051454 | 4/2015 |
| WO | WO 2015/132411 | 9/2015 |
| WO | 2016/023844 | 2/2016 |
| WO | WO 2016/038095 | 3/2016 |
| WO | 2017/025362 | 2/2017 |

OTHER PUBLICATIONS

GenBank Accession No. AAS07253.1, dated Jan. 31, 2004 (3 pages).
Gloster, "Advances in understanding glycosyltransferases from a structural perspective," Curr Opin Struct Biol. 28:131-41 (2014).
Guo et al., "Protein tolerance to random amino acid change", Proceedings of the National Academy of Sciences USA, vol. 101, No. 25, pp. 9205-9210 (2004).
Ni et al., "Outer membrane mutation effects on UDP-glucose permeability and whole-cell catalysis rate," Appl Microbiol Biotechnol. 73(2):384-93 (2006).
Prisic et al, "Synergistic substrate inhibition of ent-copalyl diphosphate synthase: a potential feed-forward inhibition mechanism limiting gibberellin metabolism," Plant Physiol. 144(1):445-54 (2007).
Unligil et al., "Glycosyltransferase structure and mechanism," Curr Opin Struct Biol. 10(5):510-7 (2000).

(56) References Cited

OTHER PUBLICATIONS

Wanchao et al., "Advances on the Stevoil Glycoside Biosynthesis and Its Key Enzymes," Biotechnology Bulletin, Feb. 2008 (English Abstract translation).

International Search Report issued by the International Searching Authority for International Application No. PCT/US2011/038967, dated Sep. 1, 2011 (10 pages).

Written Opinion of the International Searching Authority for International Application No. PCT/US2011/038967, dated Sep. 1, 2011 (12 pages).

International Preliminary Report on Patentability issued by the International Bureau for International Application No. PCT/US2011/038967, dated Dec. 4, 2012 (13 pages).

Third-Party Submission under 37 CFR 1.290 for U.S. Appl. No. 13/701,406, dated Mar. 22, 2013 (238 pages).

Extended European Search Report and Opinion issued by the European Patent Office for European Application No. 11790428.4, dated Dec. 20, 2013.

Search Report issued by the Intellectual Property Office of Singapore for Singaporean Application No. 201208854-8, dated Nov. 3, 2014.

Non-Final Office Action for U.S. Appl. No. 14/237,540, dated Dec. 30, 2015 (pp. 1-19).

Final Office Action issued in U.S. Appl. No. 14/237,540; dated Jul. 8, 2016, pp. 1-19.

International Search Report issued by the International Searching Authority for International Application No. PCT/US2012/050021, dated Apr. 12, 2013.

Written Opinion of the International Searching Authority for International Application No. PCT/US2012/050021, dated Apr. 12, 2013.

International Preliminary Report on Patentability issued by the International Bureau for International Application No. PCT/US2012/050021, dated Feb. 11, 2014.

Extended European Search Report issued in EP 15193074.0; dated Feb. 12, 2016, pp. 1-9.

International Search Report from the International Searching Authority for International Application No. PCT/EP2014/052363, dated Sep. 22, 2014 (12 pages).

Written Opinion of the International Searching Authority for International Application No. PCT/EP2014/052363, dated Sep. 22, 2014 (10 pages).

International Preliminary Report on Patentability issued by the International Bureau for International Application No. PCT/EP2014/052363, dated Aug. 11, 2015. (11 pages).

International Preliminary Report on Patentability issued by the International Bureau for International Application No. PCT/EP2014/052675, dated Aug. 11, 2015 (8 pages).

International Search Report of the International Searching Authority for International Application No. PCT/EP2013/075587, dated Feb. 20, 2014 (pp. 1-5).

Written Opinion of the International Searching Authority for International Application No. PCT/EP2013/075587, dated Feb. 20, 2014 (pp. 1-9).

International Preliminary Report on Patentability from the International Bureau for International Application No. PCT/EP2013/075587, dated Jun. 9, 2015 (pp. 1-10).

Third Party Submission in U.S. Appl. No. 14/648,747; dated Mar. 28, 2016, pp. 1-231.

Invitation to Pay Additional Fees and, Where Applicable, Protest Fee by the International Searching Authority for International Application No. PCT/EP2015/070620, dated Nov. 27, 2015 (pp. 1-14).

International Search Report by the International Searching Authority for International Application No. PCT/EP2015/070620; dated Mar. 29, 2016, pp. 1-10.

Written Opinion of the International Searching Authority for International Application No. PCT/EP2015/070620; dated Mar. 29, 2016, pp. 1-24.

International Search Report and Written Opinion of the International Searching Authority for International Application No. PCT/EP2015/068314, dated Jan. 20, 2016 (pp. 1-7).

Written Opinion of the International Searching Authority for International Application No. PCT/EP2015/068314, dated Jan. 20, 2016 (pp. 1-9).

International Search Report and Written Opinion of the International Searching Authority for International Application No. PCT/EP2015/052007; dated Jul. 4, 2016, pp. 1-24.

Chen, "Summary on Study of Stevioside," China Pharmacist, 10(6):598-599 (2007).

Chen et al., "Sugar transporters for intercellular exchange and nutrition of pathogens," Nature 468(7323):527-32 (2010).

Chen et al., "Fusion protein linkers: Property, design, and functionality", Advanced Drug Delivery reviews, 65(0):1257-69 (2013).

Daran et al., "Genetic and biochemical characterization of the UGP1 gene encoding the UDP-glucose pyrophosphorylase from *Saccharomyces cerevisiae*," Eur J Biochem. 233(2):520-30 (Jul. 1995).

Husar et al., "Overexpression of the UGT73C6 alters brassinosteriod glucoside formation in *Arabidopsis thaliana*", BMC Plant Biology, 11:1-14 (2011).

Malonek et al., "The NADPH-cytochrome P450 Reductase Gene from Gibberalla fujikuroi is Essential for Gibberellin Biosynthesis", J Bio Chem. 279(24):25075-84 (Jun. 2004).

Mao et al., "Produce steviol glycosides in engineered yeast, 2015 Synthetic Biology: Engineering, Evolution & Design (SEED)", Poster Abstract (Jun. 2015).

Nagatoshi et al., "UGT75L6 and UGT94E5 mediate sequential glucosylation of crocetin to crocin in Gardenia jasminoides", FEBS Letters, 586:1055-1061 (2012).

Tiwari et aL, "Plant secondary metabolism linked glycosyltransferases: An update on expanding knowledge and scopes", Biotechnology Advances, 34:714-739 (May 2016).

Wang et al., "Pathway mining-based integration of critical enzyme parts for de novo biosynthesis of steviol glycoside sweetener in *Escherichia coli*", Cell Research, 26:258-261 (Sep. 2015).

Wang et al., "Efficient enzymatic production of rebaudioside A from stevioside", Bioscience, Biotechnology, and Biochemistry, 80:67-73 (Aug. 2015).

Wang et al., "Design and construction of artificial biological systems for complex natural products biosynthesis", Chinese Journal of Biotechnology, 29:114-1160, (2013).

Warth et al., "Hydrophilic interaction liquid chromatography coupled with tandem mass spectrometry for the quantification of uridine diphosphate-glucose, uridine diphosphate-glucuronic acid, deoxynivalenol and its glucoside: In-house validation and application to wheat," Journal of Chromatography A, 1423, pp. 183-189 (2015).

Yang et al., "Base substitution mutations in uridinediphosphate-dependent glycosyltransferase 76G1 gene of Stevia rebaudioside A; Mustation in UGT76G1, a key gene of steviol glycoside synthesis", Plant Physiology and Biochemistry, 80:220-225 (2014).

Examination Report issued by the European Patent Office for European Application No. 12750513.9, dated Nov. 26, 2014.

Non-Final Office Action for U.S. Appl. No. 14/764,898, dated Mar. 30, 2017, pp. 1-17.

Final Office Action for U.S. Appl. No. 14/648,747, dated Sep. 6, 2017, pp. 1-19.

Third Party Observation in EP Application No. 13801569.8; mailed Oct. 23, 2017. pp. 1-6.

International Search Report and Written Opinion of International Search Authority for International Application No. PCT/EP2017/055589; dated May 12, 2017, pp. 1-18.

International Search Report of the International Searching Authority for International Application No. PCT/EP2017/061774; dated Aug. 30, 2017, pp. 1-20.

Written Opinion of the International Searching Authority for International Application No. PCT/EP2017/061774; dated Aug. 30, 2017, pp. 1-13.

International Search Report and Written Opinion of the International Searching Authority for International Application No. PCT/EP2017/061775; dated Sep. 6, 2017, pp. 1-17.

(56) References Cited

OTHER PUBLICATIONS

Boer, "Strain and process development for fermentative production of Rebaudiosides" Abstract of Offered Oral from 33rd International Specialised Symposium on Yeasts; Jun. 26-29, 2017 University of College Cork, Ireland; pp. 1-2.
Communication of a Notice of Opposition issued by the European Patent Office for European Application No. 12750513.9, dated Mar. 6, 2017 (pp. 1-8).
Mahe et al., "The ATP Binding Cassette Transporters Pdr5 and Snq2 of *Saccharomyces cerevisiae* Can Mediate Transport of Sterids via in Vivo", JBC, 271(41):25167-25172. (Oct. 1996).
Starratt et al., "Rebaudioside F, a diterpene glycoside from Stevia redaudiana", Phytochemistry, 59(4):367-370. (Feb. 2002). Abstract.
Sequence alignment between the sequence of Uniprot database entry Q75183 version 31, updated Jul. 22, 2008 and Seq ID No. 152 (from European Patent No. 2742142) as cited in Notice of Opposition against EP Application No. 12750513.9; mailed Mar. 6, 2017; pp. 1-2.
Non-Final Office Action for U.S. Appl. No. 14/761,629, dated Mar. 21, 2017 (pp. 1-19).
Statement of fact and arguments in support of opposition, dated Feb. 28, 2017 (pp. 1-24).
Uniprot Accession No. Q75183, dated Jul. 5, 2004 (pp. 1-2).
Uniprot Accession No. Q75183, dated Jul. 22, 2008 (pp. 1-4).
Third Party Observation in EP Application No. 13801569.8; mailed Apr. 26, 2017. pp. 1-5.
International Search Report and Written Opinion of International Search Authority for International Application No. PCTEP2017/059028; dated Jun. 27, 2017, pp. 1-15.
Shao et al., "Crystal structures of a multifunctional triterpene/flavonoid glycosyltransferase from Medicago truncatula," Plant Cell 17(11):3141-54 (2005).
Shibata et al., "Glucosylation of Steviol and Steviol-Glucosides in Extracts from Stevia rebaudiana Bertoni" Plant Physiol. 95(1):152-56 (1991).
Singh et al., "Compendium of Transgenic Crop Plants: Transgenic Sugar, Tuber and Fiber," Ed. Kole & Hall, Blackwell Publishing Ltd. pp. 97-115 (2008).
U.S. Food and Drug Administration GRAS Notice 323, "GRAS Assessment of High Purity Steviol Glycosides; Food Usage Conditions for General Recognition of Safety for PureCircle USA, Inc.," pp. 1-262 (Feb. 2010).
U.S Food and Drug Administration GRAS Notice Notice 329, "Notice to the U.S. Food and Drug Administration that the use of Rebpure™ (Rebaudioside A) derived from Stevia rebaudiana, as a Food Ingredient is Generally Recognized as Safe (GRAS)," pp. 1-275 (Mar. 2010).
Van Ooyen et al., "Heterologous protein production in the yeast *Kluyveromyces lactis*," FEMS Yeast Res. 6(3):381-92 (May 2006).
Vazquez De Aldana et al., "Nucleotide sequence of the exo-1,3-beta-glucanase-encoding gene, EXG1, of the yeast *Saccharomyces cerevisiae*," Gene 97(2):173-82 (1991).
Verwaal et al., "High-Level Production of Beta-Carotene in *Saccharomyces cerevisiae* by Successive Transformation with Carotenogenic Genes from Xanthophyllomyces dendrorhous," Appl Environ Microbiol. 73(13):4342-50 (2007).
Wallin, "Steviol Glycosides," Chem. Tech Assessment—63rd JECFA, pp. 1-5 (2004).
Wallin, "Steviol Glycosides," Chem. Tech Assessment—69th JECFA, pp. 1-7 (2007).
Wallner & Elofsson, "Can correct protein models be identified?," Protein Sci. 12(5):1073-86 (May 2003).
Wang, "Structure, mechanism and engineering of plant natural product glycosyltransferases," FEBS Letters 583(20):3303-9 (2009).
Xu et al., "Generation of hepatitis B virus PreS2-S antigen in Hansenula polymorpha," Virol Sin. 29(6):403-9 (Dec. 2014).
Yadav et al., "A review on the improvement of stevia [*Stevia rebaudiana* (Bertoni)]," Can J Plant Sci. 91:1-27 (2011).
Yao et al., "A genetic linkage map for Stevia rebaudiana," Genome 42:657-61 (1999).

Yazaki, "ABC transporters involved in the transport of plant secondary metabolites," FEBS Lett. 580(4):1183-91 (Feb. 2006).
Yu et al., "Bioconversion of ethyl 4-chloro-3-oxobutanoate by permeabilized fresh brewer's yeast cells in the presence of allyl bromide," J Ind Microbiol Biotechnol. 34(2)151-6 (2007).
Yuan et al., "Kinetics and activation parameters for oxidations of styrene by Compounds I from the cytochrome P450 (BM-3) (CYP102A1) heme domain and from CYP119," Biochemistry 48(38):9140-6 (Sep. 2009).
Zheng et al. "An efficient one-step site-directed and site-saturation mutagenesis protocol," Nucleic Acids Res. 32(14):e115 (Aug. 2004).
Zhu et al., "A multi-omic map of the lipid-producing yeast *Rhodosporidium toruloides*," Nature Commun. 3:1112 (Oct. 2012).
GenBank Accession No. AAF61439.1, dated Sep. 25, 2000 (2 pages).
GenBank Accession No. AAM53963.1, dated Jun. 17, 2002 (2 pages).
GenBank Accession No. AAR06918.1, dated Dec. 28, 2004 (2 pages).
GenBank Accession No. AAT93110.1, dated Apr. 24, 2007 (2 pages).
GenBank Accession No. ACE87855.1, dated Jun. 24, 2008 (1 page).
GenBank Accession No. ACM47734.1, dated Feb. 7, 2009 (1 page).
GenBank Accession No. ACT33422.1, dated Jul. 17, 2009 (1 page).
GenBank Accession No. AF515727.1, dated Jun. 17, 2002 (2 pages).
GenBank Accession No. AY345974.1, dated Dec. 28, 2004 (2 pages).
GenBank Accession No. AY345978.1, dated Dec. 28, 2004 (2 pages).
Genbank Accession No. AY345980.1, dated Dec. 28, 2004 (2 pages).
GenBank Accession No. AY345982.1, dated Dec. 28, 2004 (2 pages).
GenBank Accession No. BG521726.1, dated May 13, 2000 (2 pages).
GenBank Accession No. CAA23011.1, dated Oct. 23, 2008 (2 pages).
GenBank Accession No. CAA46815.1, dated Apr. 18, 2005 (2 pages).
GenBank Accession No. DQ269454.4, dated May 28, 2008 (2 pages).
GenBank Accession No. EU722415.1, dated Jun. 10, 2008 (2 pages).
GenBank Accession No. EU751291.1, dated Jun. 24, 2008 (2 pages).
EBI Accession No. AAY05902, "Jerusalem artichoke in-chain hydroxylase CYP81B1" (1 page).
EBI Accession No. ABM86477, "Rice abiotic stress responsive polypeptide SEQ ID No. 4723" (1 page).
UniProt Accession No. F2DG34, May 2011 (pp. 1-4).
UniProt Accession No. Q6VAA8, 2004 (pp. 1-6).
UniProt Accession No. Q7FPQ4, 2004 (pp. 1-6).
Abraham & Bhat, "Permeabilization of bakers yeast with N-lauroyl sarcosine," J Ind Microbial Biotechnol. 35(8):799-804 (2008).
Ageitos et al., "Oily yeasts as oleaginous cell factories," Appl Microbiol Biotechnol. 90(4):1219-27 (May 2011).
Agrawal, "NMR spectroscopy in the structural elucidation of oligosaccharides and glycosides," Phytochemistry 31(10):3307-30 (1992).
Ajikumar et al., "Terpenoids: opportunities for biosynthsis of natural product drugs using engineered microorganisms," Molecular Pharmaceuticals 5(2):167-90 (2008).
Alakomi et al., "Lactic acid permeabilizes gram-negative bacteria by disrupting the outer membrane," Appl Environ Microbiol. 66(5):2001-5 (2000).
Ali et al., "Biochemical investigation during different stages of in vitro propagation of Stevia rebaudiana," Pak J Bot. 42(4):2827-37 (2010).
Bankar et al., "Environmental and industrial applications of Yarrowia lipolytica," Appl Microbiol Biotechnol. 84(5):847-65 (Oct. 2009).

(56) References Cited

OTHER PUBLICATIONS

Baykov et al., "A malachite green procedure for orthophosphate determination and its use in alkaline phosphatase-based enzyme immunoassay," Anal Biochem. 171(2):266-70 (Jun. 1988).
Beopoulos et al., "Yarrowia lipolytica: A model and a tool to understand the mechanisms implicated in lipid accumulation," Biochimie 91(6):692-6 (Jun. 2009).
Brandle et al., "Leaf ESTs from Stevia rebaudiana: A Resource for Gene Discovery in Diterpene Synthesis," Plant Mol Biol. 50(4-5):613-22 (2002).
Brandle & Telmer, "Steviol glycoside biosynthesis," Phytochemistry 68(14):1855-63 (2007).
Brochado et al. "Improved vanillin production in baker's yeast through in silico design," Microb Cell Fact. 9:84-98 (2010).
Carretero-Paulet et al., "Expression and Molecular Analysis of the *Arabidopsis* DXR Gene Encoding 1-Deoxy-d-Xylulose 5-Phosphate Reductoisomerase, the First Committed Enzyme of the 2-C-Methyl-D-Erythritol 4-Phosphate Pathway," Plant Physiol. 129(4):1581-91 (2002).
Ceunen & Geuns, "Steviol glycosides: chemical diversity, metabolism, and function," J. Nat. Prod. 76(6):1201-28 (Jun. 2013).
Chemler et al., "Biosynthesis of isoprenoids, polyunsaturated fatty acids and flavonoids in *Saccharomyces cerevisiae*," Microb Cell Fact. 5:20 (2006).
Chen et al., "MolProbity: all-atom structure validation for macromolecular crystallography," Acta Crystallogr D Biol Crystallogr 66(Pt 1):12-21 (Jan. 2010).
Chica et al., "Semi-rational approaches to engineering enzyme activity: combining the benefits of directed evolution and rational design," Curr Opin Biotechnol.16(4):378-84 (2005).
Chow & Palecek, "Enzyme encapsulation in permeabilized *Saccharomyces cerevisiae* cells," Biotechnol Prog. 20(2):449-56 (2004).
Correa et al., "Genetic mapping of 1,3-beta-glucanase-encoding genes in *Saccharomyces cerevisiae*," Current Genet. 22(4):283-8 (1992).
Darise et al., "Enzymic Transglucosylation of Rubusoside and the Structure-Sweetness Relationship of Steviol-Bisglycosides," Agric. Biol. Chem. 48(10):2483-8 (Jan. 1984).
Davis et al., "MolProbity: all-atom contacts and structure validation for proteins and nucleic acids," Nucleic Acids Res. 35:W375-83 (Apr. 2007).
Del Sorbo et al., "Fungal transporters involved in efflux of natural toxic compounds and fungicides," Fungal. Genet. Biol. 30(1):1-15 (Jun. 2000).
Diener et al., "*Arabidopsis* ALF5, a multidrug efflux transporter gene family member, confers resistance to toxins," Plant Cell 13(7):1625-38 (Jul. 2001).
Dodhia et al., "Engineering human cytochrome P450 enzymes into catalytically self-sufficient chimeras using molecular Lego," J Biol Inorg Chem. 11(7):903-16 (Oct. 2006).
Dubey, et al., An overview of the non-mevalonate pathway for terpenoid biosynthesis in plants, J. Biosci. 28(5):637-46 (2003).
Dubois & Stephenson, "Diterpenoid sweeteners. Synthesis and sensory evaluation of stevioside analogues with improved organoleptic properties," J. Med. Chem. 28(1):93-8 (Jan. 1985).
EFSA Panel on Food Additives and Nutrient Sources added to Food (ANS), "Scientific Opinion on the safety of steviol glycosides for the proposed uses as a food additive," EFSA Journal 8(4):1537 (2010).
Eisenreich et al., "Biosynthesis of isoprenoids via the non-mevalonate pathway," Cell Mol Life Sci. 61(12):1401-6 (2004).
EMBOSS Needle results for Pairwise Sequence Alignment of UGT91D1 and UGT91D2; dated Apr. 4, 2016, 2 pages.
Emmerstorfer et al., "Over-expression of ICE2 stabilizes cytochrome P450 reductase in *Saccharomyces cerevisiae* and Pichia pastoris," Biotechnol J. 10(4):623-35 (Apr. 2015).
Estrada De Martin et al., "Ice2p is important for the distribution and structure of the cortical ER network in *Saccharomyces cerevisiae*," J Cell Sci. 118(Pt 1):65-77 (Oct. 2006).

Fernandez et al., "Activation of chitin synthetase in permeabilized cells of a *Saccharomyces cerevisiae* mutant lacking proteinase B," J Bacteriol. 152(3):1255-64 (1982).
Flores et al., "Permeabilization of yeast cells (*Kluyveromyces lactis*) with organic solvents," Enzyme Microb Technol. 16(4):340-6 (1994).
Fowler & Zabin, "Effects of Dimethylsulfoxide on the Lactose Operon in *Escherichia coli*," J Bacteriol. 92(2):353-7 (1966).
Freire, "Differential scanning calorimetry," Methods Mol Biol. 40:191-218 (1995).
Fukunaga et al., "Enzymatic transglucosylation products of stevioside: separation and sweetness-evaluation," Agric. Biol. Chem. 53(6):1603-7 (Jan. 1989).
Geuns, "Stevioside," Phytochemistry 64(5):913-21 (2003).
Giaever & Nislow, "The yeast deletion collection: a decade of functional genomics," Genetics 197(2):451-65 (Jun. 2014).
Gietz & Schiestl, "High-efficiency yeast transformation using the LiAc/SS carrier DNA/PEG method," Nat Protoc. 2(1):31-4 (2007).
Girvan et al., "Flavocytochrome P450 BM3 mutant W1046A is a NADH-dependent fatty acid hydroxylase: implications for the mechanism of electron transfer in the P450 BM3 dimer," Arch Biochem Biophys. 507(1):75-85 (Mar. 2011).
Goralczyk, "Compounds from Stevia for Improving and Maintaining Mental Performance," Stevia World Forum, Feb. 24-25, 2010, 17 pages.
Guleria & Yadav, "Insights into Steviol Glycoside Biosynthesis Pathway Enzymes Through Structural Homology Modeling," Am. J. Biochem. Molec. Biol. 3(1):1-19 (2013).
Gunel et al., "Metabolic Engineering for Production of Geranylgeranyl Pyrophosphate Synthase in Non-Carotenogenic Yeast *Schizosaccharomyces pombe*," Biotechnol. & Biotechnol. Eq. 20(3):76-82 (2006).
Hansen et al., "De novo biosynthesis of vanillin in fission yeast (*Schizosaccharomyces pombe*) and baker's yeast (*Saccharomyces cerevisiae*)," Appl Environ Microbiol. 75(9):2765-74 (2009).
Hansen et al., "Versatile Enzyme Expression and Characterization System for Aspergillus nidulans, with the Penicillium brevicompactum Polyketide Synthase Gene from the Mycophenolic Acid Gene Cluster as a Test Case," Appl Environ Microbiol. 77(9):3044-51 (2011).
Hellfritsch et al., "Human psychometric and taste receptor responses to steviol glycosides," J. Agric. Food Chem. 60(27):6782-93 (Jul. 2012).
Humphrey et al., "Spatial organisation of four enzymes from Stevia rebaudiana that are involved in steviol glycoside synthesis," Plant Mol Bio. 61(1-2):47-62 (2006).
Iandolino et al., "High-Quality RNA, cDNA, and Derived EST Libraries From Grapevine (*Vitis vinifera* L.)," Plant Mol Biol Reporter 22:269-78 (2004).
Irmler et al., "Indole alkaloid biosynthesis in Catharanthus roseus: new enzyme activities and identification of cytochrome P450 CYP72A1 as secologanin synthase," Plant J. 24(6):797-804 (2000).
Jennewein et al., "Taxol biosynthesis: baxane 13 alpha-hydroxylase is a cytochrome P450-dependent monooxygenase," Proc Natl Acad Sci U S A 98(24):13595-600 (2001).
Bateman et al., "Pfam 3.1: 1313 multiple alignments and profile HMMs match the majority of proteins," Nucleic Acids Res. 27(1)260-2 (Jan. 1999).
Bay & Turner, "Diversity and evolution of the small multidrug resistance protein family," BMC Evol. Biol. 9:140 (Jun. 2009).
Brachmann et al., "Designer deletion strains derived from *Saccharomyces cerevisiae* S288C: a useful set of strains and plasmids for PCR-mediated gene disruption and other applications," Yeast 14:115-32 (1998).
Chen et al., "Transferring a biosynthetic cycle into a productive *Escherichia coli* strain: large-scale synthesis of galactosides," J. Am. Chem. Soc. 123(36):8866-7 (Sep. 2001).
Chenna et al., "Multiple sequence alignment with the Clustal series of programs," Nucleic Acids Res. 31(13):3497-500 (Jul. 2003).
GenBank Accession No. AAB62280, dated Jul. 2, 1997 (2 pages).
GenBank Accession No. AAB87091, dated Mar. 22, 2000 (2 pages).
GenBank Accession No. AAC28895.1, dated Aug. 6, 1998 (2 pages).
GenBank Accession No. AAC39505, dated Jul. 26, 1998 (1 page).

(56) References Cited

OTHER PUBLICATIONS

GenBank Accession No. AAD34294, dated Mar. 22, 2000 (2 pages).
GenBank Accession No. AAD34295, dated Mar. 22, 2000 (2 pages).
GenBank Accession No. AAD47596, dated Aug. 9, 1999 (2 pages).
GenBank Accession No. AAH69913, dated Jul. 15, 2006 (2 pages).
GenBank Accession No. AEE36246, dated Oct. 6, 2014 (3 pages).
GenBank Accession No. AAR06912, dated Dec. 28, 2004 (2 pages).
GenBank Accession No. AAR06916.1, dated Dec. 28, 2004 (2 pages).
GenBank Accession No. AAR06920.1, dated Dec. 28, 2004 (2 pages).
GenBank Accession No. ABA42921, dated Jun. 21, 2006 (1 page).
GenBank Accession No. ABB88839, dated May 28, 2008 (2 pages).
GenBank Accession No. ABC59076, dated Jun. 6, 2007 (1 page).
GenBank Accession No. ABC98596, dated Jan. 31, 2014 (2 pages).
GenBank Accession No. ABD60225, dated May 28, 2008 (2 pages).
GenBank Accession No. ABD92926, dated Oct. 10, 2007 (2 pages).
GenBank Accession No. AC133334, dated Jan. 31, 2004 (44 pages).
GenBank Accession No. ACD93722, dated Jun. 10, 2008 (1 page).
GenBank Accession No. AF034774, dated Apr. 17, 1998 (2 pages).
GenBank Accession No. AY562490, dated May 23, 2006 (3 pages).
GenBank Accession No. BAA43200, dated Mar. 13, 1999 (2 pages).
GenBank Accession No. BAB59027, dated Jan. 30, 2002 (1 page).
GenBank Accession No. BAF61135, dated May 9, 2007 (2 pages).
GenBank Accession No. BAG30962, dated Nov. 12, 2012 (2 pages).
GenBank Accession No. BC153262, dated Oct. 4, 2007 (3 pages).
GenBank Accession No. CAA75568, dated Nov. 14, 2006 (2 pages).
GenBank Accession No. CAA76703, dated Nov. 14, 2006 (1 page).
GenBank Accession No. CAE09055, dated Nov. 14, 2006 (2 pages).
GenBank Accession No. CAG41604, dated Feb. 6, 2015 (2 pages).
GenBank Accession No. DQ398871.3, dated May 28, 2008 (2 pages).
GenBank Accession No. EDY51667, dated Sep. 2, 2008 (2 pages).
GenBank Accession No. EU263989, dated Jun. 11, 2008 (2 pages).
GenBank Accession No. NM_116512, dated Jan. 22, 2014 (3 pages).
GenBank Accession No. NP_001105097, dated Aug. 4, 2015 (2 pages).
GenBank Accession No. NP_013636.1 (YML075C), dated Jul. 16, 2015 (3 pages).
GenBank Accession No. NP_194183, dated Jan. 22, 2014 (4 pages).
GenBank Accession No. NP_195399, dated Jan. 22, 2014 (3 pages).
GenBank Accession No. NP_197872.1, dated Jan. 22, 2014 (2 pages).
GenBank Accession No. Q9UVY5.1, dated Apr. 1, 2015 (3 pages).
Jewett et al. "An integrated cell-free metabolic platform for protein production and synthetic biology," Mol Syst Biol. 4:220 (2008).
Johnstone et al., "Cloning an Aspergillus nidulans developmental gene by transformation," EMBO J. 4(5):1307-11 (1985).
Khoury et al., "Computational design of Candida boidinii xylose reductase for altered cofactor specificity," Protein Sci. 18(10):2125-38 (Oct. 2009).
Kim et al., "Hydroxylation of ent-Kaurenoic Acid to Steviol in Stevia rebaudiana Bertoni—Purification and Partial Characterization of the Enzyme," Arch Biochem Biophys. 332(2):223-30 (1996).
Kim & Shibata, "Characterization of ent-kaurenoic acid 13-hydroxylase in steviol biosynthesis of Stevia rebaudiana Bertoni," Journal of the Korean Agriculturalchemical Society 40(6):501-7 (1997).
Knowles et al., "Genetic Transformation and Plant Regeneration in Stevia rebaudiana Using Microprojectile Bombardment," In Vitro Cellular & Developmental Biology 39(abstract):23-A (2003).
Kohda et al., "New Sweet Diterpene glucoside from Stevia Rebaudiana," Phytochemistry 15(6):981-3 (1976).
Kondo et al., "Preparation of high activity whole cell biocatalyst by permeabilization of recombinant flocculent yeast with alcohol," Enzyme Microb Technol. 27(10),806-11 (2000).
Kumar et al., "A comprehensive analysis of fifteen genes of steviol glycosides biosynthesis pathwayin Stevia rebaudiana (Bertoni)" Gene 492:276-84 (Epub Oct. 20, 2011).
Kusama et al., "Transglucosylation into stevioside by the enzyme system from Streptomyces sp.," Agric. Biol. Chem. 50(10):2445-51 (Oct. 1986).
Li et al., "Crystal structure of Medicago truncatula UGT85H2—insights into the structural basis of a multifunctional (iso) flavonoid glycosyltransferase," J Mol Biol. 370(5):951-63 (2007).
Li et al., "Systematic Mutational Analysis of Peptide Inhibition of the p53-MDM2/MDMX," J Mol Biol. 398(2):200-13 (2010).
Li et al., "High-density cultivation of oleaginous yeast Rhodosporidium toruloides Y4 in fed-batch culture," Enzyme and Microbial Technology 41(3):312-7 (Aug. 2007).
Liu et al., "Preparation of high-activity whole cell biocatalysts by permeabilization of recombinant yeasts with alcohol," J Biosci Bioeng. 89(6):554-8 (2000).
Ma et al., "Molecular cloning and characterization of Stevia Rebaudiana UDP-glucosyltransferase," Acta Biologiae Experimentalis Sinica 36(2):123-9 (2003).
Ma "Part 1. Molecular Cloning and Functional Analysis of UDPG Glucosyltransferase Gene. Part 2. Molecular Cloning, Sequence Analysis and Evolution of Actin and EF1a Genes in Stevia Rebaudiana." Chinese Doctor and Master Dissertations Full-Text Database, Agricultural Technology Part, vol. 2; pp. 1-74 (2004).
Madan et al., "Stevia rebaudiana (Bert.) Bertoni—A Review," Indian Journal of Natural Products and Resources 1(3)267-86 (2010).
Madhav et al., "Functional and structural variation of uridine diphosphate glycosyltransferase (UGT) gene of Stevia rebaudiana—UGTSr involved in the synthesis of rebaudioside A," Plant Physiol. Biochem. 63:245-53 (Feb. 2013).
Malonek et al., "The NADPH-cytochrome P450 Reductase Gene from Gibberalla fujikuroi is Essential for Gibberellin Biosynthesis," J Bio Chem. 279(24):25075-84 (2004).
Mantovaneli et al., "The effect of temperature and flow rate on the clarification of the aqueous stevia-extract in a fixed-bed column with zeolites," Braz J Chem Eng. 21(3):449-58 (2004).
Mattanovich et al., "Recombinant protein production in yeasts," Methods Mol Biol. 824:329-58 (2012).
Megeji et al., "Introducing Stevia rebaudiana, a natural zero-calorie sweetener," Current Science 88(5):801-4 (2005).
Mohamed et al., "UDP-dependent glycosyltransferases involved in the biosynthesis of steviol glycosides" Journal of Plant Physiology 168(10):1136-1141 (Jul. 2011; Epub Apr. 7, 2011).
Mumberg et al., "Yeast vectors for the controlled expression of heterologous proteins in different genetic backgrounds," Gene 156(1):119-22 (1995).
Naesby et al., "Yeast artificial chromosomes employed for random assembly of biosynthetic pathways and production of diverse compounds in Saccharomyces cerevisiae," Microb Cell Fact. 8:45 (2009).
Naglak & Wang, "Rapid protein release from Escherichia coli by chemical permeabilization under fermentation conditions," Biotechnol Bioeng. 39(7):732-40 (1991).
Nakagiri et al., "cDNA cloning, functional expression and characterization of ent-copalyl diphosphate synthase from Scoparia dulcis L.," Plant Sci. 169:760-7 (2005).
Nelson et al., "P450 superfamily: update on new sequences, gene mapping, accession numbers and nomenclature," Pharmacogenetics 6:1-42 (1996).
Newman et al., "High-level production of amorpha-4,11-diene in a two-phase partitioning bioreactor of metabolically engineered Escherichia coli," Biotechnol Bioeng 95(4):684-91 (2006).
Nicaud, "Yarrowia lipolytica," Yeast 29(10):409-18 (Oct. 2012).
Nielsen et al., "Efficient PCR-based gene targeting with a recyclable marker for Aspergillus nidulans," Fungal Genet Biol. 43(1):54-64 (2006).
Nour-Eldin et al., "USER cloning and USER fusion: the ideal cloning techniques for small and big laboratories," Methods Mol Biol. 643:185-200 (2010).
Ohta et al., "Characterization of Novel Steviol Glycosides from Leaves of Stevia rebaudiana Morita," J. Applied Glycosides 57(3):199-209 (Mar. 2010).
Ohta et al., MassBank Accession No. FU000341 (May 2011).
Ohta et al., MassBank Accession No. FU000342 (May 2011).

(56) References Cited

OTHER PUBLICATIONS

Ohta et al., MassBank Accession No. FU000343 (May 2011).
Ohtani et al., "Further Study on the 1,4-alpha-Transglucosylation of Rubusoside, a Sweet Steviol-Bisglucoside from Rubus suavissimus," Agric Biol Chem. 55(2):449-53 (1991).
Oka & Jigami, "Reconstruction of de novo pathway for synthesis of UDP-glucuronic acid and UDP-xylose from intrinsic UDP-glucose in *Saccharomyces cerevisiae*," FEBS J. 273(12):2645-57 (2006).
Orihara et al., "Biotransformation of steviol by cultured cells of eucalyptus perriniana and Coffea Arabica," Phytochemistry 30(12):3989-92 (1991).
Paradise et al., "Redirection of flux through the FPP branch-point in *Saccharomyces cerevisiae* by down-regulating squalene synthase," Biotechnol Bioeng. 100(2):371-8 (2008).
Pearson & Lipman, "Improved tools for biological sequence comparison," Proc Natl Acad Sci. 85(8):2444-8 (1998).
Piirainen et al., "Glycoengineering of yeasts from the perspective of glycosylation efficiency," N Biotechnol. 31(6):532-7 (Dec. 2014).
Pompon et al., "Yeast Expression of Animal and Plant P450s in Optimized RedoxEnvironments," Methods Enzymol 272:51-64 (1996).
Prelich, "Gene overexpression: uses, mechanisms, and interpretation," Genetics 190(3):841-54 (Mar. 2012).
Presecki & Vasic-Racki, "Production of L-malic acid by permeabilized cells of commercial *Saccharomyces* sp. strains," Biotechnol Lett. 27(23-24):1835-9 (2005).
Ro et al., "Production of the antimalarial drug precursor artemisinic acid in engineered yeast," Nature 440(7086):940-3 (2006).
Saenge et al., "Potential use of oleaginous red yeast *Rhodotorula glutinis* for the bioconversion of crude glycerol from biodiesel plant to lipids and carotenoids," Process Biochemistry 46(1):210-8 (Jan. 2011).
Schwab et al., Poster, "Watchmaker®—Compound Generation by Combinatorial Genetics and Screening in Yeast," 141st Annual Conference in St. Louis, 2008, 1 page.
Sen et al., "Developments in Directed Evolution for Improving Enzyme Functions," Appl Biochem Biotechnol.143(3):212-23 (2007).
Senthilraja et al., "RNA secondary structure prediction: Analysis of *Saccharomyces cerevisiae* RNAs," Int. J. Pharm. Rev. Res. 25(2):287-91 (Mar.-Apr. 2014).
GenBank Accession No. XM_001467423, dated Jul. 16, 2015 (2 pages).
GenBank Accession No. XP_002282091, dated Dec. 7, 2011 (1 page).
GenBank Accession No. XP_002288339, dated Jul. 15, 2009 (2 pages).
GenBank Accession No. XP_002311286, dated Dec. 31, 2013 (2 pages).
GenBank Accession No. ZP_05004570, dated Jun. 8, 2010 (2 pages).
Gossen & Bujard, "Studying gene function in eukaryotes by conditional gene inactivation," Annu. Rev. Genet. 36:153-73 (Jun. 2002).
Gritz & Davies, "Plasmid-encoded hygromycin B resistance: the sequence of hygromycin B phosphotransferase gene and its expression in *Escherichia coli* and *Saccharomyces cerevisiae*," Gene 25(2-3):179-88 (Nov. 1983).
Hallstrom & Moye-Rowley, "Divergent transcriptional control of multidrug resistance genes in *Saccharomyces cerevisiae*," J. Biol. Chem. 273(4):2098-104 (Jan. 1998).
Katzmann et al., "Expression of an ATP-binding cassette transporter-encoding gene (YOR1) is required for oligomycin resistance in *Saccharomyces cerevisiae*," Mol. Cell Biol. 15(12):6875-83 (Dec. 1995).
Li et al., "Phylogenetic analysis of the UDP-glycosyltransferase multigene family of *Arabidopsis thaliana*," J. Biol. Chem. 276(6):4338-43 (Oct. 2000).
Masada et al., "An efficient chemoenzymatic production of small molecule glucosides with in situ UDP-glucose recycling," FEBS Lett. 581(13):2562-6 (May 2007).

Morita et al., "Japanese morning glory dusky mutants displaying reddish-brown or purplish-gray flowers are deficient in a novel glycosylation enzyme for anthocyanin biosynthesis, UDP-glucose:anthocyanidin 3-O-glucoside-2"-O-glucosyltransferase, due to 4-bp insertions in the gene," Plant J. 42(3):353-63 (May 2005).
Nagy et al., "Role of the yeast ABC transporter Yor1p in cadmium detoxification," Biochimie 88(11):1665-71 (Jun. 2006).
Nikaido & Takatsuk, "Mechanisms of RND multidrug efflux pumps," Biochim. Biophys. Acta. 1794(5):769-81 (May 2009).
Osmani et al., "Catalytic key amino acids and UDP-sugar donor specificity of a plant glucuronosyltransferase, UGT94B1: molecular modeling substantiated by site-specific mutagenesis and biochemical analyses," Plant Physiol. 148(3):1295-308 (Nov. 2008).
Osmani et al., "Substrate specificity of plant UDP-dependent glycosyltransferases predicted from crystal structures and homology modeling," Phytochemistry 70(3):325-47 (Feb. 2009).
Richman et al., "Functional genomics uncovers three glucosyltransferases involved in the synthesis of the major sweet glucosides of Stevia rebaudiana," Plant J. 41(1):56-67 (Jan. 2005).
Riesmeier et al., "Isolation and characterization of a sucrose carrier cDNA from spinach by functional expression in yeast," EMBO J. 11(13):4705-13 (Dec. 1992).
Rodríguez-Concepción & Boronat, "Elucidation of the methylerythritol phosphate pathway for isoprenoid biosynthesis in bacteria and plastids. A metabolic milestone achieved through genomics," Plant Physiol. 130(3):1079-89 (Nov. 2002).
Saier Jr et al., "The major facilitator superfamily," J. Mol. Microbiol. Biotechnol. 1(2):257-79 (Nov. 1999).
Saier Jr et al., "The Transporter Classification Database: recent advances," Nucleic Acids Res. 37:D274-8 (Jan. 2009).
Sauer et al., "The soluble and membrane-bound transhydrogenases UdhA and PntAB have divergent functions in NADPH metabolism of *Escherichia coil*," J. Biol. Chem. 279(8):6613-9 (Dec. 2003).
Sawada et al., "UDP-glucuronic acid:anthocyanin glucuronosyltransferase from red daisy (*Bellis perennis*) flowers. Enzymology and phylogenetics of a novel glucuronosyltransferase involved in flower pigment biosynthesis," J. Biol. Chem. 280(2):899-906 (Jan. 2005).
Shao et al., "Enhanced production of alpha-galactosyl epitopes by metabolically engineered Pichia pastoris," Appl. Environ. Microbiol. 69(9):5238-42 (Sep. 2003).
Son et al., "Production of flavonoid O-glucoside using sucrose synthase and flavonoid O-glucosyltransferase fusion protein," J. Microbiol. Biotechnol. 19(7):709-12 (Jul. 2009).
Sonnhammer et al., "Pfam: a comprehensive database of protein domain families based on seed alignments," Proteins 28(3):405-20 (Jul. 1997).
Sonnhammer et al., "Pfam: multiple sequence alignments and HMM-profiles of protein domains," Nucleic Acids Res. 26(1):320-2 (Jan. 1998).
Yadav et al., "Steviol Glycosides from Stevia: Biosynthesis Pathway Review and their Application in Foods and Medicine", Critical Reviews in Food Science and Nutrition, vol. 52, No. 11, pp. 988-998; (2012).
International Search Report by the International Searching Authority for International Application No. PCT/EP2014/052675, dated Apr. 23, 2014 (5 pages).
Written Opinion of the International Searching Authority for International Application No. PCT/EP2014/052675, dated Apr. 23, 2014 (7 pages).
Non-Final Office Action for U.S. Appl. No. 14/648,747, dated Mar. 23, 2017 (pp. 1-20).
International Preliminary Report on Patentability from the International Bureau for International Application No. PCT/EP2015/068314, dated Feb. 14, 2017 (pp. 1-10).
International Search Report and Written Opinion of the International Searching Authority for International Application No. PCT/EP2016/080516; dated Mar. 15, 2017, pp. 1-22.
Garber et al., "Computational methods for transcriptome annotation and quantification using RNA-seq," Nat Methods 8(6):469-77 (2011).
Kawai et al., "Transformation of *Saccharomyces cerevisiae* and other fungi: methods and possible underlying mechanism," Bioeng Bugs. 1(6):395-403 (2010).

(56) References Cited

OTHER PUBLICATIONS

Lin et al., "Arrestin-related ubiquitin-ligase adaptors regulate endocytosis and protein turnover at the cell surface," Cell 135(4):714-25 (2008).
Nagalakshmi et al., "The transcriptional landscape of the yeast genome defined by RNA sequencing," Science 320 (5881 ): 1344-9 (2008).
Nikko & Pelham, "Arrestin-mediated endocytosis of yeast plasma membrane transporters," Traffic 10(12):1856-67 (2009).
Nikko et al. "Arrestin-like proteins mediate ubiquitination and endocytosis of the yeast metal transporter Smf1," EMBO Rep. 9(12):1216-21 (2008).
Ohta et al., MassBank Accession No. FU000299 (May 2016).
Ohta et al., MassBank Accession No. FU000332 (May 2016).
Olsson et al., "Microbial production of next-generation stevia sweeteners," Microbial Cell Factories, 15:11-14 (2016).
Partow et al., "Characterization of different promoters for designing a new expression vector in *Saccharomyces cerevisiae*," Yeast 27:955-64 (2010).
Robinson & Oshlack et al., "A scaling normalization method for differential expression analysis of RNA-seq data," Genome Bioi. 11(3):R25 (2010).
Saier Jr. et al., "The transporter classification database," Nucl. Acids Res., 42(1):D251-258 (2014).
Song et al., "The Aspergillus fumigatus 1-29 damage resistance protein family coordinately regulates ergosterol biosynthesis and azole susceptibility," MBIO, 7:1-13 (2016).
Wang et al., "RNA-Seq: a revolutionary tool for transcriptomics," Nat Rev Genet. 10(1):57-63 (2009).
Wilhelm et al., "Defining transcribed regions using RNA-seq," Nature Protocols 5:255-66 (2010).
Yang Quanhua et.al., "Analysis of the Chemical constituents of Stevia rebaudiana and its sweetness," Journal of Beijing University of Chemical Technology, vol. 39, No. 2., pp. 28-32 (2012) (English Abstract).
Final Office Action for U.S. Appl. No. 14/761,629, dated Aug. 11, 2017 (pp. 1-16).
Liu et al., "Functional and Biochemical Characteritzation of *Escherichia coli* Sugar Efflux Transporters," JBC, 274(33):22977-22984 (Aug. 1999).
Sun et al., "Regulation and Function of *Escherichia coli* Sugar Efflux Transporter A (Set A) during Glucose-Phosphate Stress," J of Bacteriology, 193(1):143-153 (Jan. 2011).
International Search Report and Written Opinion of the International Searching Authority for International Application No. PCT/EP2016/068259; dated Jan. 24, 2017, pp. 1-18.
International Preliminary Report on Patentability from the International Bureau for International Application PCT/EP2015/052007; dated Aug. 1, 2017 (pp. 1-16).

\* cited by examiner

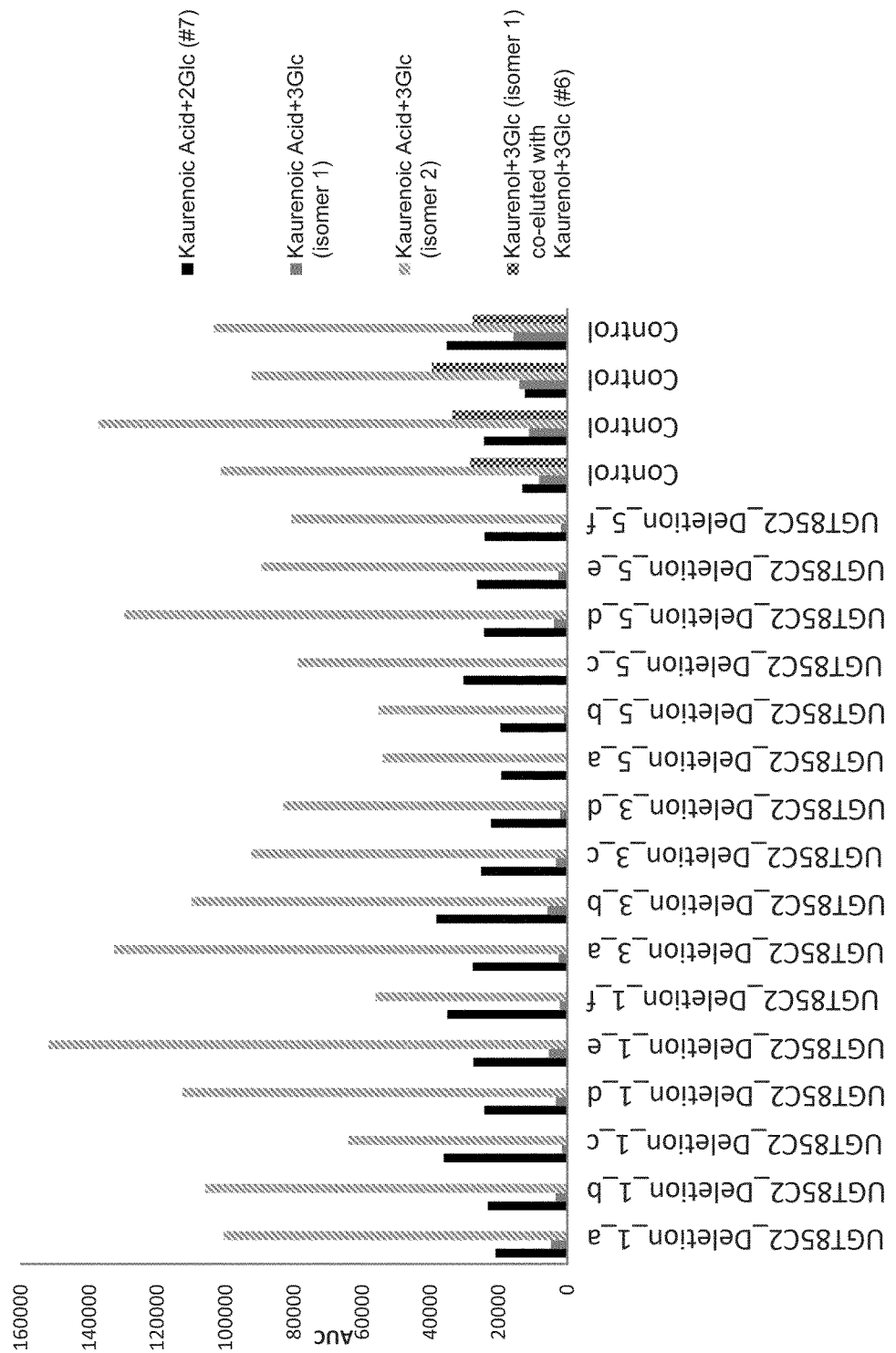

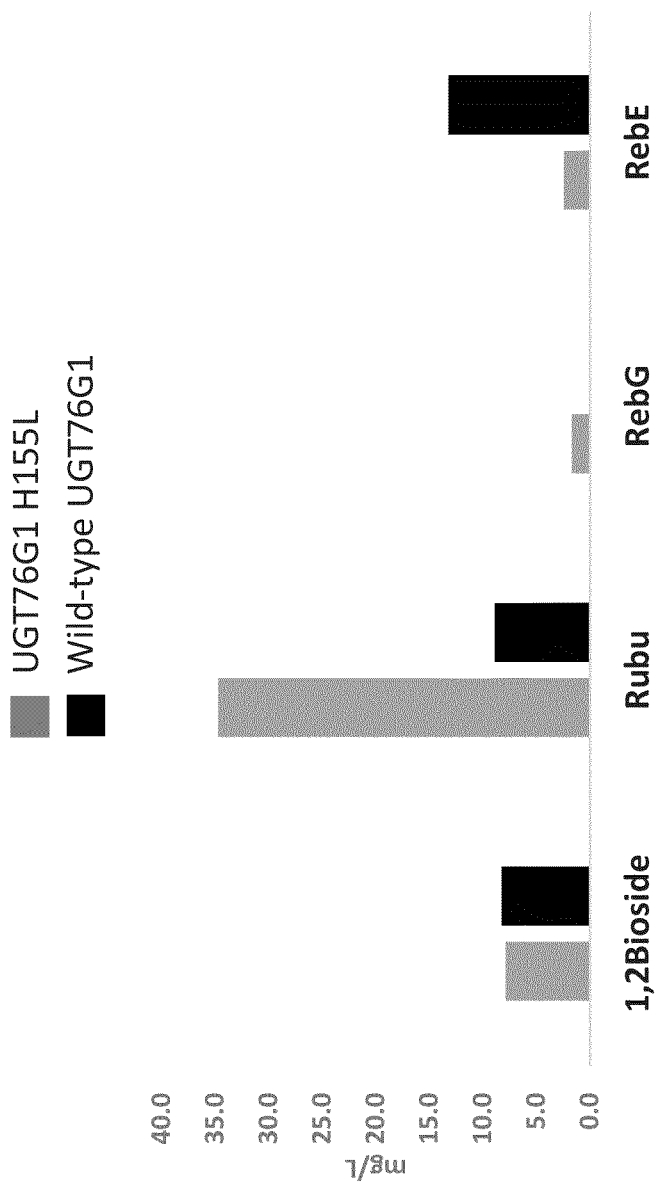

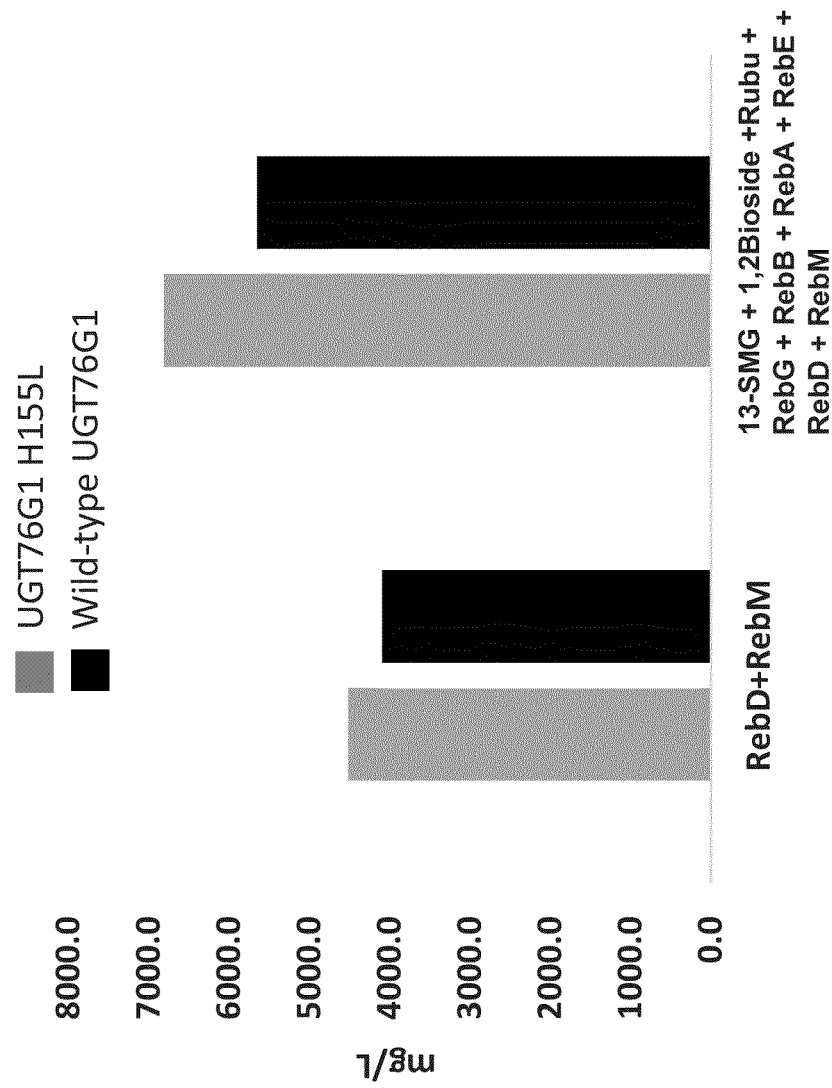

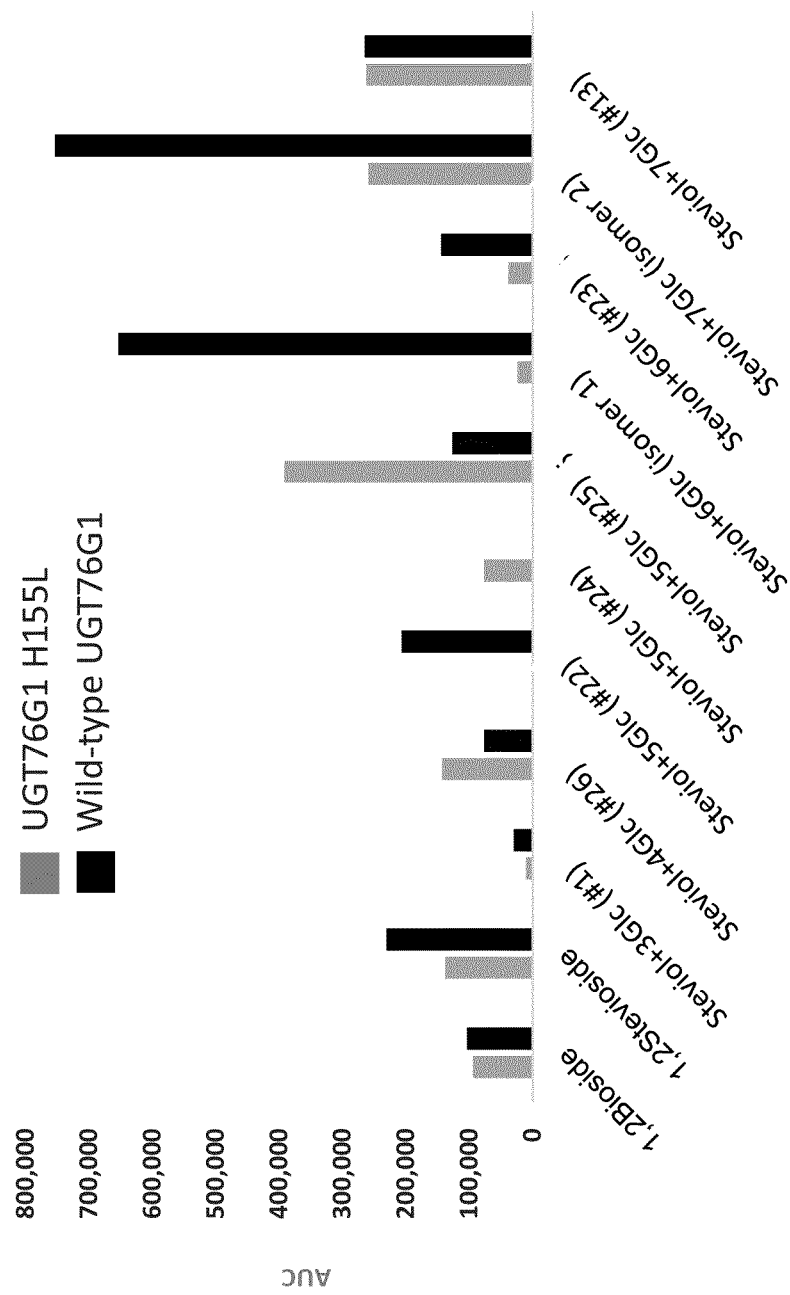

Figure 7A
Kaurenoic acid+3Glc (isomer 2)
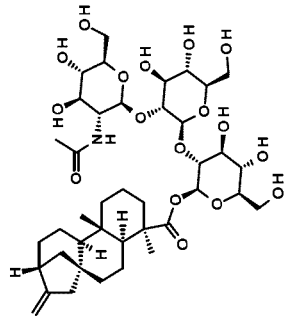
Formula Weight : 788.87(3)
Exact Mass : 788.38305050(3)
Formula : $C_{38}H_{60}O_{17}$
Kaurenol+3Glc (isomer 1)
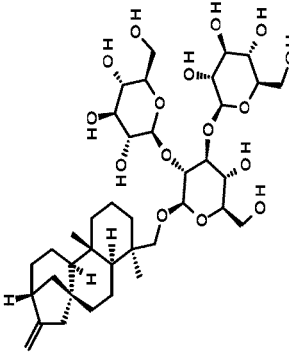
Formula Weight : 774.89(3)
Exact Mass : 774.40378594(3)
Formula : $C_{38}H_{62}O_{16}$
Kaurenoic acid+3Glc (isomer 1)
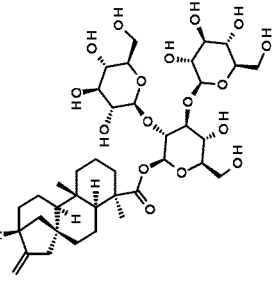
Formula Weight : 788.87(3)
Exact Mass : 788.38305050(3)
Formula : $C_{38}H_{60}O_{17}$
Kaurenoic acid+2Glc+1GlcNAc
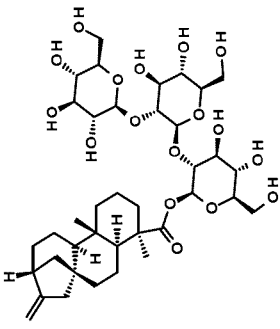
Formula Weight : 829.92(3)
Exact Mass : 829.40959960(4)
Formula : $C_{40}H_{63}NO_{17}$ Figure 7B
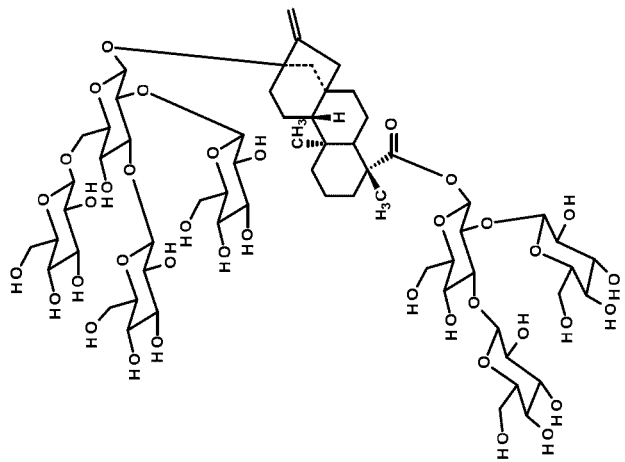
Steviol+7Glc (isomer 2)
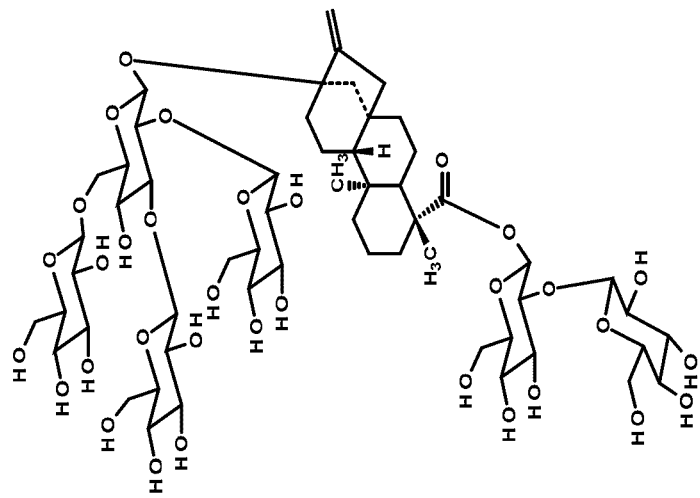
Steviol+6Glc (isomer 1)

Figure 7C
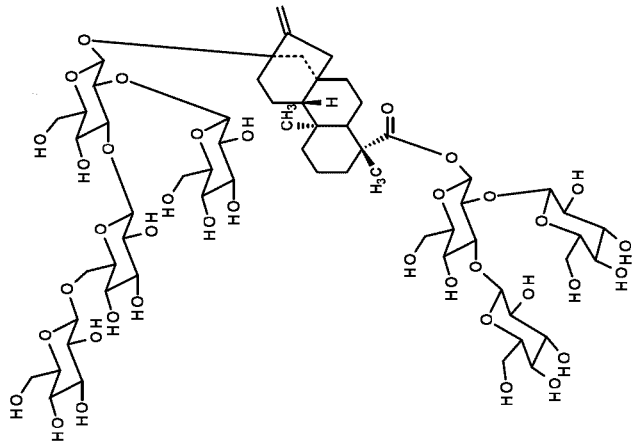
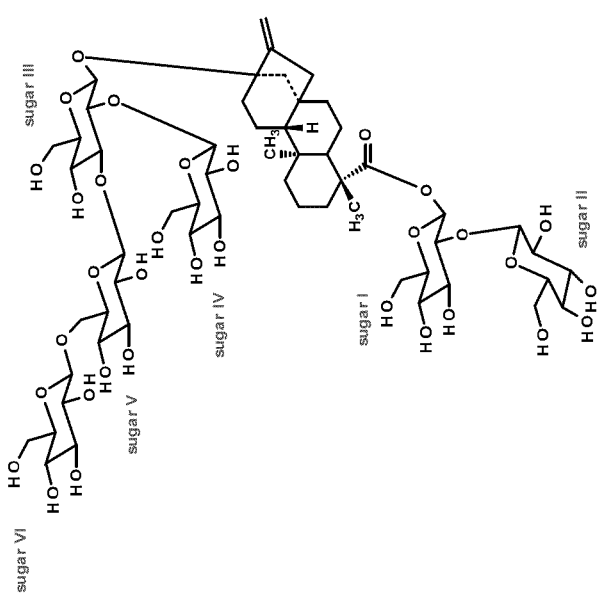

Figure 7D
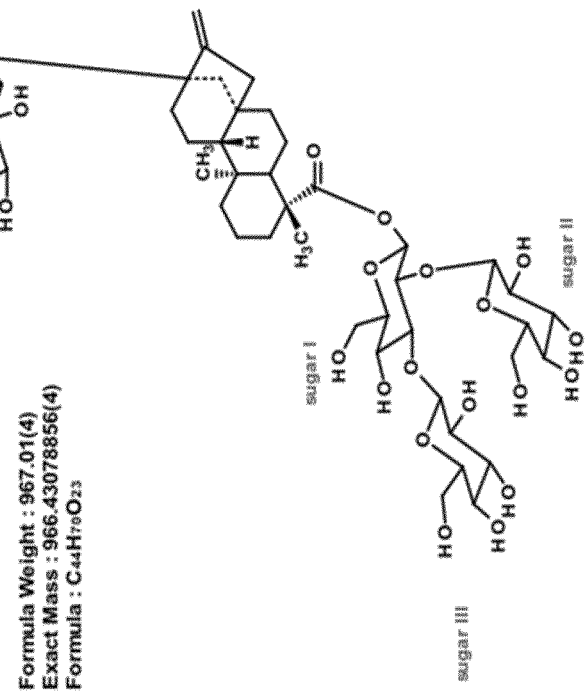
Steviol+4Glc (#26)
Formula Weight : 967.01(4)
Exact Mass : 966.4307856(4)
Formula : C44H70O23
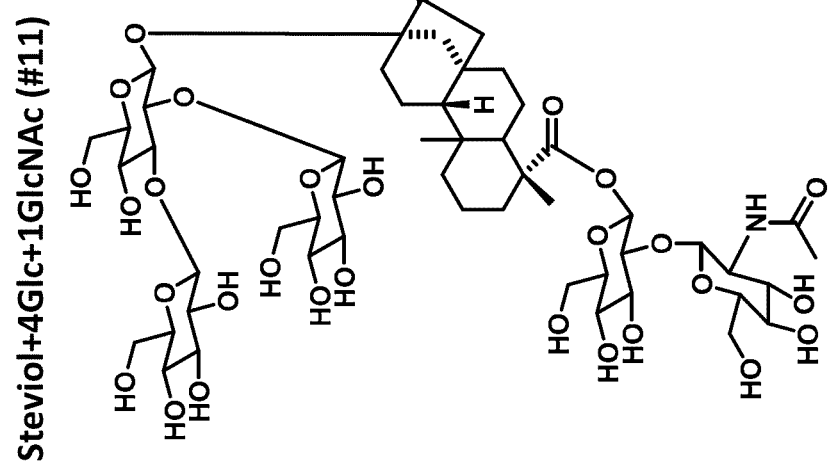
Steviol+4Glc+1GlcNAc (#11)

Kaurenoic Acid+3Glc (isomer 1)

Figure 8B

Kaurenoic Acid+3Glc (isomer 1)

$^1$H NMR (800 MHz, DMSO $d_6$) δ ppm 0.74 - 0.81 (m, 1 H) 0.83 - 0.90 (m, 3 H) 0.97 (td, J=13.33, 4.16 Hz, 1 H) 1.02 - 1.10 (m, 3 H) 1.15 (s, 3 H) 1.30 - 1.44 (m, 3 H) 1.44 - 1.50 (m, 1 H) 1.50 - 1.62 (m, 3 H) 1.72 - 1.87 (m, 4 H) 1.91 - 1.99 (m, 2 H) 2.06 (d, J=17.12 Hz, 1 H) 2.16 (d, J=12.72 Hz, 1 H) 2.59 (br. s., 1 H) 2.98 - 3.06 (m, 2 H) 3.07 - 3.15 (m, 4 H) 3.16 - 3.26 (m, 3 H) 3.30 - 3.33 (m, 1 H) 3.42 (dd, J=11.00, 5.14 Hz, 1 H) 3.44 - 3.49 (m, 1 H) 3.50 - 3.55 (m, 1 H) 3.60 - 3.67 (m, 2 H) 3.68 - 3.75 (m, 3 H) 4.31 (d, J=7.82 Hz, 1 H) 4.34 - 4.37 (m, 1 H) 4.41 (t, J=5.38 Hz, 1 H) 4.48 (t, J=5.62 Hz, 1 H) 4.72 (s, 1 H) 4.78 (br. s., 1 H) 4.93 (d, J=5.38 Hz, 1 H) 4.96 - 5.02 (m, 3 H) 5.04 (d, J=7.83 Hz, 1 H) 5.12 (d, J=5.38 Hz, 1 H) 5.18 (d, J=2.45 Hz, 1 H) 5.43 (d, J=7.83 Hz, 1 H) 5.52 (d, J=2.45 Hz, 1 H)

$^{13}$C NMR (201.21 MHz, DMSO $d_6$) δ ppm 175.4 (1C), 155.3 (1C), 104.6 (1C), 103.6 (1C), 99.8 (1C), 92.4 (1C), 83.4 (1C), 77.6 (1C), 77.5 (1C), 77.2 (1C), 76.9 (1C), 76.2 (1C), 76.1 (1C), 75.8 (1C), 75.2 (1C), 70.8 (1C), 70.0 (1C), 69.8 (1C), 61.5 (1C), 61.4 (1C), 60.6 (1C), 56.7 (1C), 54.6 (1C), 48.7 (1C), 43.9 (1C), 43.4 (1C), 43.3 (1C), 41.2 (1C), 40.4 (1C), 40.0 (1C), 39.4 (1C), 37.8 (1C), 32.9 (1C), 28.5 (1C), 21.6 (1C), 19.1 (1C), 18.5 (1C), 16.1 (1C)

| Atom1 | Shift1 (ppm) | H's | Type | J (Hz) | Multiplet1 | (ppm) |
|---|---|---|---|---|---|---|
| 55<'> | 0.78 | 1 | m | - | M34 | [0.74 .. 0.81] |
| 57 | 0.86 | 3 | m | - | M33 | [0.83 .. 0.90] |
| 53<'> | 0.97 | 1 | td | 13.33, 4.16 | M32 | [0.92 .. 1.00] |
| 13a, 2a, 10<'> | 1.07 | 3 | m | - | M31 | [1.02 .. 1.10] |
| 52 | 1.15 | 3 | s | - | M30 | [1.12 .. 1.18] |
| 11<'>, 4<'>, 54<''> | 1.38 | 3 | m | - | M29 | [1.30 .. 1.44] |
| 11<''> | 1.47 | 1 | m | - | M28 | [1.44 .. 1.50] |
| 4<''>, 3 | 1.56 | 3 | m | - | M27 | [1.50 .. 1.62] |
| 55<''>, 12, 54<''> | 1.79 | 4 | m | - | M26 | [1.72 .. 1.87] |
| 10<''>, 8<'> | 1.95 | 2 | m | - | M25 | [1.91 .. 1.99] |
| 8<''> | 2.06 | 1 | d | 17.12 | M24 | [2.02 .. 2.08] |
| 53<''> | 2.16 | 1 | d | 12.72 | M23 | [2.12 .. 2.19] |
| 5a | 2.59 | 1 | br. s. | - | M22 | [2.57 .. 2.61] |
| 38<ax>, 26<ax> | 3.02 | 2 | m | - | M14 | [2.98 .. 3.06] |
| 30<ax>, 40<ax>, 28<ax>, 32<ax> | 3.10 | 4 | m | - | M15 | [3.07 .. 3.15] |
| 46<ax>, 23<ax>, 48<ax> | 3.22 | 3 | m | - | M16 | [3.16 .. 3.26] |
| 36<ax> | 3.32 | 1 | m | - | M21 | [3.30 .. 3.33] |
| 33<'> | 3.42 | 1 | dd | 11.00, 5.14 | M35 | [3.41 .. 3.43] |
| 49<'> | 3.46 | 1 | m | - | M20 | [3.44 .. 3.49] |
| 41<'> | 3.52 | 1 | m | - | M19 | [3.50 .. 3.55] |
| 44<ax>, 49<''> | 3.64 | 2 | m | - | M18 | [3.60 .. 3.67] |
| 41<''>, 33<''>, 20<ax> | 3.71 | 3 | m | - | M17 | [3.68 .. 3.75] |
| 25<ax> | 4.31 | 1 | d | 7.82 | M11 | [4.28 .. 4.33] |
| 50 | 4.35 | 1 | m | - | M10 | [4.34 .. 4.37] |
| 42 | 4.41 | 1 | t | 5.38 | M09 | [4.39 .. 4.43] |
| 34 | 4.48 | 1 | t | 5.62 | M08 | [4.45 .. 4.51] |
| 58<a> | 4.72 | 1 | s | - | M07 | [4.69 .. 4.74] |
| 58<b> | 4.78 | 1 | br. s. | - | M06 | [4.76 .. 4.81] |
| 31 | 4.93 | 1 | d | 5.38 | M13 | [4.91 .. 4.95] |
| 27, 39, 29 | 4.99 | 3 | m | - | M12 | [4.96 .. 5.02] |
| 22<ax> | 5.04 | 1 | d | 7.83 | M05 | [5.02 .. 5.06] |
| 47 | 5.12 | 1 | d | 5.38 | M04 | [5.09 .. 5.14] |
| 45 | 5.18 | 1 | d | 2.45 | M03 | [5.15 .. 5.21] |
| 19<ax> | 5.43 | 1 | d | 7.83 | M02 | [5.40 .. 5.46] |
| 37 | 5.52 | 1 | d | 2.45 | M01 | [5.49 .. 5.54] |

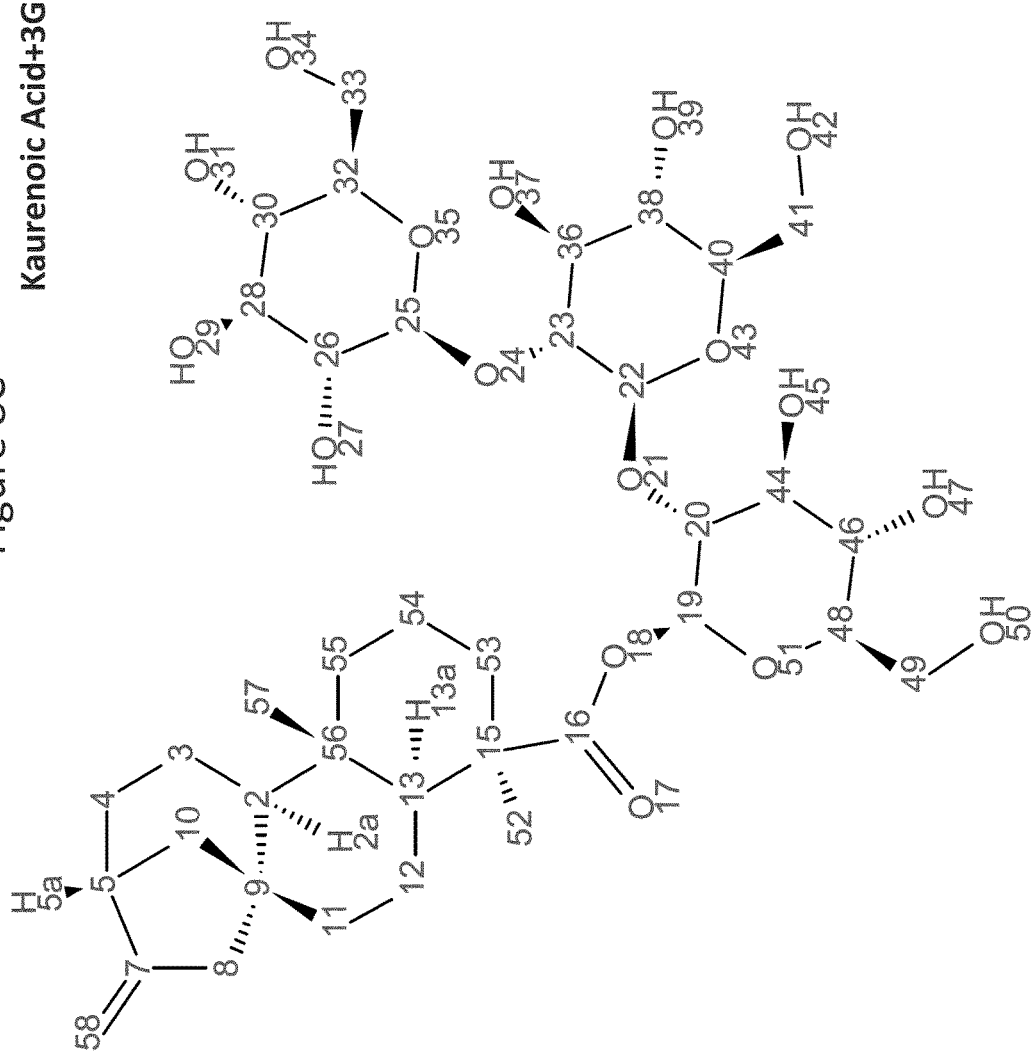
Figure 8C  Kaurenoic Acid+3Glc (isomer 1)

Kaurenoic Acid+3Glc (isomer 2)

Figure 8E

Kaurenoic Acid+3Glc (isomer 2)

$^1$H NMR (800 MHz, DMSO $d_6$) δ ppm 0.73 - 0.80 (m, 1 H) 0.83 (s, 3 H) 0.92 (td, J=13.33, 4.16 Hz, 1 H) 1.00 - 1.04 (m, 1 H) 1.04 - 1.10 (m, 2 H) 1.17 (s, 3 H) 1.33 - 1.38 (m, 1 H) 1.38 - 1.44 (m, 2 H) 1.49 (d, J=12.72 Hz, 1 H) 1.51 - 1.59 (m, 3 H) 1.75 - 1.83 (m, 4 H) 1.88 - 1.93 (m, 1 H) 1.93 - 1.98 (m, 1 H) 2.03 - 2.09 (m, 1 H) 2.27 - 2.34 (m, 1 H) 2.58 (br. s., 1 H) 2.83 - 2.88 (m, 1 H) 2.89 - 2.95 (m, 1 H) 3.04 - 3.10 (m, 2 H) 3.12 - 3.19 (m, 4 H) 3.19 - 3.23 (m, 1 H) 3.30 - 3.35 (m, 2 H) 3.39 - 3.44 (m, 2 H) 3.4 - 3.53 (m, 1 H) 3.64 (dd, J=10.51, 4.16 Hz, 1 H) 3.73 (d, J=7.83 Hz, 3 H) 3.78 (s, 1 H) 4.09 - 4.14 (m, 1 H) 4.34 (t, J=5.14 Hz, 1 H) 4.48 (d, J=7.83 Hz, 1 H) 4.56 (t, J=5.62 Hz, 1 H) 4.66 (t, J=4.89 Hz, 1 H) 4.69 (d, J=2.45 Hz, 1 H) 4.72 (s, 1 H) 4.79 (br. s., 1 H) 4.86 (d, J=7.83 Hz, 1 H) 4.95 (br. s., 2 H) 5.04 (d, J=4.89 Hz, 1 H) 5.11 (br. s., 1 H) 5.16 (d, J=6.36 Hz, 1 H) 5.49 (d, J=8.31 Hz, 2 H)

$^{13}$C NMR (201.21 MHz, DMSO $d_6$) δ ppm 175.1 (1C), 155.4 (1C), 103.7 (1C), 103.2 (1C), 101.5 (1C), 92.1 (1C), 86.8 (1C), 77.9 (1C), 77.3 (1C), 77.1 (1C), 77.0 (1C), 76.8 (1C), 74.4 (1C), 73.9 (1C), 71.2 (1C), 70.2 (1C), 68.2 (1C), 61.8 (1C), 61.1 (1C), 60.6 (1C), 56.7 (1C), 54.6 (1C), 48.8 (1C), 44.0 (1C), 43.6 (1C), 43.4 (1C), 41.1 (1C), 40.0 (1C), 39.5 (1C), 39.4 (1C), 37.1 (1C), 32.8 (1C), 28.4 (1C), 21.6 (1C), 19.3 (1C), 18.2 (1C), 16.2 (1C)

| Atom1 | Shift1 (ppm) | H's | Type | J (Hz) | Multiplet1 | (ppm) |
|---|---|---|---|---|---|---|
| 46<'> | 0.77 | 1 | m | - | M40 | [0.73 .. 0.80] |
| 61 | 0.83 | 3 | s | - | M07 | [0.81 .. 0.85] |
| 44<'> | 0.92 | 1 | td | 13.33, 4.16 | M39 | [0.89 .. 0.96] |
| 2a | 1.03 | 1 | m | - | M38 | [1.00 .. 1.04] |
| 57<'>, 48a | 1.07 | 2 | m | - | M37 | [1.04 .. 1.10] |
| 43 | 1.17 | 3 | s | - | M06 | [1.13 .. 1.21] |
| 45<'> | 1.36 | 1 | m | - | M36 | [1.33 .. 1.38] |
| 51<'>, 58<'> | 1.40 | 2 | m | - | M35 | |
| 58<''> | 1.49 | 1 | d | 12.72 | M34 | |
| 50, 51<''> | 1.54 | 3 | m | - | M33 | |
| 46<''>, 45<''>, 59 | 1.78 | 4 | m | - | M32 | |
| 57<''> | 1.90 | 1 | m | - | M05 | |
| 55<'> | 1.95 | 1 | m | - | M04 | |
| 55<''> | 2.06 | 1 | m | - | M03 | |
| 44<''> | 2.31 | 1 | m | - | M02 | |
| 52a | 2.58 | 1 | br. s. | - | M01 | |
| 19<ax> | 2.86 | 1 | m | - | M31 | |
| 15<ax> | 2.92 | 1 | m | - | M30 | |
| 31<ax>, 24<ax> | 3.07 | 2 | m | - | M29 | |
| 17<ax>, 12<ax>, 29<ax> | 3.16 | 4 | m | - | M28 | |
| 33<ax> | 3.21 | 1 | m | - | M27 | |
| 39<ax>, 37<ax> | 3.32 | 2 | m | - | M26 | |
| 34<'>, 13<'> | 3.41 | 2 | m | - | M25 | |
| 40<'> | 3.50 | 1 | m | - | M24 | |
| 40<''> | 3.64 | 1 | dd | 10.51, 4.16 | M23 | |
| 34<''>, 13<''>, 21<ax> | 3.73 | 3 | d | 7.83 | M22 | |
| 8<ax> | 3.78 | 1 | s | - | M21 | |
| 25 | 4.12 | 1 | m | - | M41 | |
| 14 | 4.34 | 1 | t | 5.14 | M20 | |
| 23<ax> | 4.48 | 1 | d | 7.83 | M08 | |
| 41 | 4.56 | 1 | t | 5.62 | M19 | |
| 35 | 4.66 | 1 | t | 4.89 | M18 | |
| 20 | 4.69 | 1 | d | 2.45 | M17 | |
| 60<a> | 4.72 | 1 | s | - | M16 | |
| 60<b> | 4.79 | 1 | br. s. | - | M15 | |
| 10<ax> | 4.86 | 1 | d | 7.83 | M09 | [4.84 .. 4.88] |
| 38, 30 | 4.95 | 2 | br. s. | - | M14 | [4.93 .. 4.99] |
| 18 | 5.04 | 1 | d | 4.89 | M13 | [5.02 .. 5.06] |
| 32 | 5.11 | 1 | br. s. | - | M12 | [5.09 .. 5.13] |
| 16 | 5.16 | 1 | d | 6.36 | M11 | [5.14 .. 5.18] |
| 7<ax> | 5.49 | 2 | d | 8.31 | M10 | [5.46 .. 5.53] |

Kaurenoic Acid+3Glc (isomer 2)

Kaurenoic Acid+2Glc+1GlcNAc

Figure 8H

Kaurenoic Acid+2Glc+1GlcNAc $^1$H NMR (800 MHz, DMSO $d_6$) δ ppm 0.77 (br. s., 1 H) 0.87 (s, 3 H) 0.93 - 1.00 (m, 1 H) 1.01 - 1.08 (m, 3 H) 1.15 (s, 3 H) 1.33 - 1.43 (m, 3 H) 1.47 (d, $J$=13.20 Hz, 1 H) 1.53 (d, $J$=10.27 Hz, 1 H) 1.57 (d, $J$=11.74 Hz, 2 H) 1.76 (br. s., 1 H) 1.77 - 1.87 (m, 6 H) 1.95 (d, $J$=14.18 Hz, 2 H) 2.05 (d, $J$=17.12 Hz, 1 H) 2.18 (d, $J$=12.23 Hz, 1 H) 2.57 (br. s., 1 H) 3.00 (br. s., 1 H) 3.04 - 3.12 (m, 2 H) 3.13 - 3.19 (m, 2 H) 3.20 - 3.31 (m, 4 H) 3.38 - 3.43 (m, 2 H) 3.43 - 3.49 (m, 1 H) 3.53 - 3.60 (m, 1 H) 3.60 - 3.67 (m, 2 H) 3.67 - 3.77 (m, 3 H) 4.33 (t, $J$=5.38 Hz, 1 H) 4.43 - 4.49 (m, 3 H) 4.53 (d, $J$=8.31 Hz, 1 H) 4.72 (br. s., 1 H) 4.78 (br. s., 1 H) 4.89 (d, $J$=5.38 Hz, 1 H) 4.95 (d, $J$=7.83 Hz, 1 H) 4.97 - 5.05 (m, 3 H) 5.08 (d, $J$=5.38 Hz, 1 H) 5.46 (d, $J$=7.82 Hz, 1 H) 7.79 - 7.84 (m, 1 H)

$^{13}$C NMR (201.21 MHz, DMSO $d_6$) δ ppm 175.6 (1C), 171.6 (1C), 155.5 (1C), 103.6 (1C), 101.9 (1C), 99.9 (1C), 92.5 (1C), 82.1 (1C), 77.6 (1C), 77.3 (1C), 77.0 (1C), 77.0 (1C), 76.1 (1C), 75.9 (1C), 74.0 (1C), 70.5 (1C), 70.3 (1C), 69.9 (1C), 61.8 (1C), 61.0 (1C), 60.9 (1C), 57.2 (1C), 56.7 (1C), 54.6 (1C), 48.8 (1C), 44.1 (1C), 43.8 (1C), 43.4 (1C), 41.3 (1C), 40.4 (1C), 39.9 (1C), 39.5 (1C), 37.6 (1C), 32.9 (1C), 28.5 (1C), 23.4 (1C), 21.6 (1C), 19.2 (1C), 18.4 (1C), 16.2 (1C)

| Atom1 | Shift1 (ppm) | H's | Type | J (Hz) | Multiplet1 | (ppm) |
|---|---|---|---|---|---|---|
| 55<'> | 0.77 | 1 | br. s. | - | M12 | [0.75...0.80] |
| 57 | 0.87 | 3 | s | - | M14 | [0.86...0.88] |
| 53<'> | 0.96 | 1 | m | - | M13 | [0.93...1.00] |
| 2a, 13a, 10<'> | 1.05 | 3 | m | - | M15 | [1.01...1.08] |
| 52 | 1.15 | 3 | s | - | M16 | [1.13...1.17] |
| 54<'>, 4<'>, 11<'> | 1.38 | 3 | m | - | M17 | [1.33...1.43] |
| 11<'> | 1.47 | 1 | d | 13.20 | M18 | [1.45...1.49] |
| 3<'> | 1.53 | 1 | d | 10.27 | M19 | [1.50...1.55] |
| 3<''>, 4<''> | 1.57 | 2 | d | 11.74 | M20 | [1.55...1.62] |
| 12<'> | 1.76 | 1 | br. s. | - | M21 | [1.72...1.77] |
| 12<''>, 55<''>, 54<''>, 3 | 1.82 | 6 | m | - | M37 | [1.77...1.87] |
| 10<''>, 8<'> | 1.95 | 2 | d | 14.18 | M22 | [1.93...2.00] |
| 8<''> | 2.05 | 2 | d | 17.12 | M23 | [2.03...2.08] |
| 53<''> | 2.18 | 1 | d | 12.23 | M24 | [2.14...2.20] |
| 5a | 2.57 | 1 | br. s. | - | M25 | [2.56...2.59] |
| 38<ax> | 3.00 | 1 | br. s. | - | M28 | [2.98...3.03] |
| 48<ax>, 23<ax> | 3.08 | 2 | m | - | M29 | [3.04...3.12] |
| 32<ax>, 30 | 3.15 | 2 | m | - | M30 | [3.13...3.19] |
| 40, 46, 36, 28 | 3.24 | 4 | m | - | M31 | [3.20...3.31] |
| 41<'>, 26 | 3.41 | 2 | m | - | M36 | [3.38...3.43] |
| 49<'> | 3.46 | 1 | m | - | M35 | [3.43...3.49] |
| 33<'> | 3.56 | 1 | m | - | M34 | [3.53...3.60] |
| 33<''>, 44<ax> | 3.65 | 2 | m | - | M33 | [3.60...3.67] |
| 41<''>, 49<''>, 20<ax> | 3.72 | 3 | m | - | M32 | [3.67...3.77] |
| 50 | 4.33 | 1 | t | 5.38 | M03 | [4.31...4.35] |
| 37, 34, 42 | 4.47 | 3 | m | - | M04 | [4.43...4.49] |
| 25<ax> | 4.53 | 1 | d | 8.31 | M05 | [4.51...4.54] |
| 58<a> | 4.72 | 1 | br. s. | - | M06 | [4.71...4.73] |
| 58<b> | 4.78 | 1 | br. s. | - | M07 | [4.78...4.79] |
| 29 | 4.89 | 1 | d | 5.38 | M08 | [4.86...4.90] |
| 22<ax> | 4.95 | 1 | d | 7.83 | M09 | [4.93...4.97] |
| 31, 39, 45 | 5.01 | 3 | m | - | M10 | [4.97...5.05] |
| 47 | 5.08 | 1 | d | 5.38 | M11 | [5.05...5.10] |
| 19<ax> | 5.46 | 1 | d | 7.82 | M02 | [5.43...5.49] |
| 27 | 7.82 | 1 | m | - | M01 | [7.79...7.84] |

Kaurenol+3Glc (isomer 1)

| Atom1 | Shift1 (ppm) | H's | Type | J (Hz) | Multiplett | (ppm) |
|---|---|---|---|---|---|---|
| 46<''> | 0.74 | 1 | m | - | M32 | [0.70 .. 0.76] |
| 44<''>, 2a | 0.84 | 2 | m | - | M25 | [0.79 .. 0.89] |
| 61 | 0.93 | 3 | s | - | M08 | [0.91 .. 0.96] |
| 43 | 0.98 | 3 | s | - | M07 | [0.96 .. 1.00] |
| 48a, 57<'> | 1.04 | 2 | m | - | M28 | [1.01 .. 1.08] |
| 45 | 1.32 | 3 | m | - | M27 | [1.28 .. 1.34] |
| 59<'> | 1.36 | 1 | m | - | M36 | [1.34 .. 1.39] |
| 51<'>, 58<'> | 1.41 | 2 | m | - | M35 | [1.39 .. 1.44] |
| 58<''> | 1.46 | 1 | m | - | M26 | [1.44 .. 1.48] |
| 59<''>, 50, 51<''> | 1.56 | 4 | m | - | M34 | [1.48 .. 1.65] |
| 44<'>, 46<'> | 1.78 | 2 | m | - | M09 | [1.74 .. 1.82] |
| 57<''>, 55<'> | 1.94 | 2 | m | - | M29 | [1.88 .. 2.00] |
| 55<''> | 2.06 | 1 | m | - | M06 | [2.02 .. 2.09] |
| 52a | 2.59 | 1 | m | - | M05 | [2.57 .. 2.62] |
| 19<ax> | 2.94 | 1 | m | - | M24 | [2.91 .. 2.97] |
| 37<ax> | 3.02 | 1 | m | - | M23 | [2.99 .. 3.04] |
| 31<ax>, 24<ax> | 3.07 | 2 | m | - | M30 | [3.04 .. 3.11] |
| 15<ax> | 3.13 | 1 | t | 9.05 | M11 | [3.11 .. 3.15] |
| 17<ax>, 29<ax>, 12<ax>, 33<ax>, 39<ax> | 3.19 | 5 | m | - | M31 | [3.15 .. 3.23] |
| 4<'> | 3.24 | 1 | m | - | M33 | [3.23 .. 3.28] |
| 8<ax>, 21<ax> | 3.46 | 2 | m | - | M22 | [3.44 .. 3.48] |
| 13<'>, 34<'>, 40<''> | 3.51 | 3 | dd | 11.74, 7.82 | M21 | [3.48 .. 3.56] |
| 13<''>, 34<''>, 40<'> | 3.67 | 3 | br. s. | - | M12 | [3.60 .. 3.72] |
| 4<''> | 3.86 | 1 | m | - | M04 | [3.83 .. 3.89] |
| 14, 10<ax> | 4.25 | 2 | d | 7.34 | M03 | [4.21 .. 4.30] |
| 23<ax> | 4.42 | 1 | d | 7.83 | M14 | [4.39 .. 4.45] |
| 35 | 4.51 | 1 | br. s. | - | M15 | [4.49 .. 4.54] |
| 38 | 4.59 | 1 | s | - | M16 | [4.56 .. 4.61] |
| 20, 7<ax> | 4.63 | 2 | d | 8.31 | M17 | [4.62 .. 4.66] |
| 60<a> | 4.71 | 1 | s | - | M18 | [4.69 .. 4.73] |
| 60<b> | 4.78 | 1 | br. s. | - | M01 | [4.75 .. 4.81] |
| 30, 41 | 4.92 | 2 | br. s. | - | M19 | [4.86 .. 4.96] |
| 18, 16, 32 | 5.07 | 3 | m | - | M20 | [5.01 .. 5.17] |
| 25 | 5.57 | 1 | m | - | M02 | [5.52 .. 5.62] |

Figure 8L

Kaurenol+3Glc (isomer 1)

$^1$H NMR (800 MHz, DMSO $d_6$) δ ppm 0.70 - 0.76 (m, 1 H) 0.79 - 0.89 (m, 2 H) 0.93 (s, 3 H) 0.98 (s, 3 H) 1.01 - 1.08 (m, 2 H) 1.28 - 1.34 (m, 1 H) 1.34 - 1.39 (m, 1 H) 1.39 - 1.44 (m, 2 H) 1.44 - 1.48 (m, 1 H) 1.48 - 1.65 (m, 4 H) 1.74 - 1.82 (m, 2 H) 1.88 - 2.00 (m, 2 H) 2.02 - 2.09 (m, 1 H) 2.57 - 2.62 (m, 1 H) 2.91 - 2.97 (m, 1 H) 2.99 - 3.04 (m, 1 H) 3.04 - 3.11 (m, 2 H) 3.13 (t, J=9.05 Hz, 1 H) 3.15 - 3.23 (m, 5 H) 3.23 - 3.28 (m, 1 H) 3.44 - 3.48 (m, 2 H) 3.51 (dd, J=11.74, 7.82 Hz, 3 H) 3.67 (br. s., 3 H) 3.83 - 3.89 (m, 1 H) 4.25 (d, J=7.34 Hz, 2 H) 4.42 (d, J=7.83 Hz, 1 H) 4.59 (s, 1 H) 4.63 (d, J=8.31 Hz, 2 H) 4.71 (s, 1 H) 4.78 (br. s., 1 H) 4.92 (br. s., 2 H) 5.01 - 5.17 (m, 3 H) 5.52 - 5.62 (m, 1 H)

$^{13}$C NMR (201.21 MHz, DMSO $d_6$) δ ppm 155.8 (1C), 103.6 (1C), 103.4 (1C), 102.3 (1C), 102.1 (1C), 86.7 (1C), 78.6 (1C), 77.1 (1C), 77.0 (1C), 76.5 (1C), 76.4 (1C), 76.2 (1C), 74.7 (1C), 73.8 (1C), 72.2 (1C), 70.5 (1C), 70.2 (1C), 68.8 (1C), 61.5 (1C), 61.3 (1C), 61.1 (1C), 56.7 (1C), 55.9 (1C), 48.9 (1C), 44.1 (1C), 43.6 (1C), 41.4 (1C), 40.4 (1C), 39.4 (1C), 39.1 (1C), 37.7 (1C), 36.4 (1C), 33.1 (1C), 28.0 (1C), 20.4 (1C), 18.4 (1C), 18.2 (1C), 18.1 (1C)

Steviol+6Glc (isomer 1)

Figure 8N

Steviol+6Glc (isomer 1)

| No. | Atom1 | Shift1 (ppm) | H's | Type | J (Hz) | Multiplet1 | (ppm) |
|---|---|---|---|---|---|---|---|
| 1 | 89, 6<″> | 0.74 | 4 | br s | - | M32 | [0.69...0.78] |
| 2 | 7a | 0.88 | 1 | m | - | M31 | [0.81...0.91] |
| 3 | 2<″> | 0.94 | 1 | m | - | M30 | [0.91...0.98] |
| 4 | 4 | 1.00 | 1 | br d | 12.72 | M29 | [0.98...1.04] |
| 5 | 90 | 1.11 | 3 | s | - | M28 | [1.07...1.15] |
| 6 | 11<″>, 14<″>, 1<″>, 9<″> | 1.34 | 4 | m | - | M26 | [1.27...1.38] |
| 7 | 13<″>, 9<″> | 1.42 | 2 | m | - | M27 | [1.38...1.49] |
| 8 | 13<″>, 10<″> | 1.64 | 2 | m | - | M25 | [1.58...1.67] |
| 9 | 6<″>, 1<″>, 10<″> | 1.72 | 3 | br d | 12.23 | M24 | [1.67...1.76] |
| 10 | 14<″> | 1.82 | 1 | br s | - | M23 | [1.79...1.86] |
| 11 | 16<″> | 1.96 | 1 | m | - | M22 | [1.89...1.98] |
| 12 | 16<″>, 11<″> | 2.00 | 2 | m | - | M21 | [1.98...2.04] |
| 13 | 2<″> | 2.10 | 1 | br d | 11.49 | M20 | [2.07...2.14] |
| 14 | 31<ax> | 2.92 | 1 | m | - | M15 | [2.90...2.95] |
| 15 | 85<ax>, 87<ax>, 35<ax>, 53<ax> | 3.05 | 4 | m | - | M14 | [3.00...3.09] |
| 16 | 80<ax>, 83<ax>, 43<ax>, 55<ax>, 56<ax>, 28<ax>, 47<ax>, 33<ax> | 3.16 | 8 | m | - | M13 | [3.10...3.21] |
| 17 | 45<ax>, 54<ax>, 74<ax>, 72<ax> | 3.25 | 4 | br dd | 17.24, 8.93 | M19 | [3.21...3.28] |
| 18 | 40<ax> | 3.31 | 1 | m | - | M11 | [3.30...3.32] |
| 19 | 69<ax>, 21<ax>, 22<ax> | 3.34 | 3 | br d | 4.65 | M18 | [3.32...3.35] |
| 20 | 29<″> | 3.38 | 1 | m | - | M12 | [3.36...3.43] |
| 21 | 81<″>, 41<″>, 58<″>, 70<″>, 24<ax> | 3.48 | 5 | m | - | M10 | [3.44...3.54] |
| 22 | 50<″> | 3.62 | 1 | br s | - | M16 | [3.59...3.64] |
| 23 | 81<″>, 41<″>, 58<″>, 76<ax>, 70<″>, 29<″> | 3.68 | 6 | m | - | M09 | [3.64...3.74] |
| 24 | 23<ax> | 3.75 | 1 | br d | 8.56 | M17 | [3.74...3.78] |
| 25 | 50<″> | 3.90 | 1 | br d | 11.25 | M06 | [3.86...3.94] |
| 26 | 52<ax> | 4.24 | 1 | d | 7.82 | M05 | [4.22...4.26] |
| 27 | 19<ax>, 38 | 4.57 | 2 | br d | 7.83 | M07 | [4.56...4.59] |
| 28 | 78<ax> | 4.60 | 1 | br d | 7.58 | M08 | [4.59...4.63] |
| 29 | 26<ax> | 4.70 | 1 | br d | 7.82 | M04 | [4.67...4.72] |
| 30 | 17<a> | 4.76 | 1 | br s | - | M03 | [4.73...4.79] |
| 31 | 17<b> | 5.02 | 1 | br s | - | M02 | [5.00...5.05] |
| 32 | 67<ax> | 5.39 | 1 | br d | 7.34 | M01 | [5.37...5.42] |

¹H NMR (800 MHz, DMSO-d₆) δ ppm 0.74 (br s, 4 H) 0.81 - 0.91 (m, 1 H) 0.91 - 0.98 (m, 1 H) 1.00 (br d, J=12.72 Hz, 1 H) 1.11 (s, 3 H) 1.27 - 1.38 (m, 4 H) 1.38 - 1.49 (m, 2 H) 1.58 - 1.67 (m, 2 H) 1.72 (br d, J=12.23 Hz, 3 H) 1.82 (br s, 1 H) 1.89 - 1.98 (m, 1 H) 1.98 - 2.04 (m, 2 H) 2.10 (br d, J=11.49 Hz, 1 H) 2.90 - 2.95 (m, 1 H) 3.00 - 3.09 (m, 4 H) 3.10 - 3.21 (m, 8 H) 3.25 (br dd, J=17.24, 8.93 Hz, 4 H) 3.30 - 3.32 (m, 1 H) 3.34 (br d, J=4.65 Hz, 3 H) 3.36 - 3.43 (m, 1 H) 3.44 - 3.54 (m, 5 H) 3.62 (br s, 1 H) 3.64 - 3.74 (m, 6 H) 3.75 (br d, J=8.56 Hz, 1 H) 3.90 (br d, J=11.25 Hz, 1 H) 4.24 (d, J=7.82 Hz, 1 H) 4.57 (br d, J=7.83 Hz, 2 H) 4.60 (br d, J=7.58 Hz, 1 H) 4.70 (br d, J=7.82 Hz, 1 H) 4.76 (br s, 1 H) 5.02 (br s, 1 H) 5.39 (br d, J=7.34 Hz, 1 H)

| F2 Atom | F2 (ppm) | F2 Atom | F2 (ppm) | | F1 Atom | F1 (ppm) | | F1 Atom | F1 (ppm) |
|---|---|---|---|---|---|---|---|---|---|
| 1<'> | 1.71 | 31<'> | 2.91 | | 1 | 19.9 | | 31 | 71.5 |
| 1<> | 1.31 | 33<ax> | 3.18 | | | | | 33 | 77.2 |
| 2<'> | 2.09 | 35<ax> | 3.01 | | 2 | 37.7 | | 35 | 75.4 |
| 2<> | 0.93 | 38<ax> | 4.56 | | | | | 38 | 103.3 |
| | | 40<ax> | 3.33 | | 3 | 44.8 | | 40 | 77.8 |
| 4 | 0.99 | 41<'> | 3.69 | | 4 | 57.4 | | 41 | 61.9 |
| | | 41<> | 3.46 | | 5 | 40.3 | | | |
| 6<'> | 1.71 | 43<ax> | 3.24 | | 6 | 40.8 | | 43 | 70.3 |
| 6<> | 0.73 | 45<ax> | 3.23 | | | | | 45 | 76.9 |
| 7a | 0.87 | 47<ax> | 3.12 | | 7 | 54 | | 47 | 74.4 |
| | | 50<'> | 3.89 | | 8 | 42.2 | | 50 | 69.3 |
| 9<'> | 1.39 | 50<> | 3.62 | | 9 | 42.1 | | | |
| 9<> | 1.31 | 52<ax> | 4.23 | | | | | 52 | 103.9 |
| 10<'> | 1.72 | 53<ax> | 3.04 | | 10 | 22.7 | | 53 | 74.2 |
| 10<> | 1.62 | 54<ax> | 3.18 | | | | | 54 | 77.2 |
| 11<'> | 2 | 55<ax> | 3.33 | | 11 | 44.4 | | 55 | 69.1 |
| 11<> | 1.34 | 56<ax> | 3.3 | | | | | 56 | 77.2 |
| | | 58<'> | 3.68 | | 12 | 88.4 | | 58 | 62 |
| 13<'> | 1.81 | 58<> | 3.46 | | 13 | 38.3 | | | |
| 13<> | 1.36 | | | | | | | 64 | 178 |
| 14<'> | 1.62 | 67<ax> | 5.38 | | 14 | 20.6 | | 67 | 93.6 |
| 14<> | 1.43 | 69<ax> | 3.23 | | | | | 69 | 76.9 |
| | | 70<'> | 3.64 | | 15 | 153.2 | | 70 | 61.6 |
| 16<'> | 1.99 | 70<> | 3.5 | | 16 | 47.4 | | | |
| 16<> | 1.94 | 72<ax> | 3.15 | | | | | 72 | 70.8 |
| 17<'a> | 4.75 | 74<ax> | 3.65 | | 17 | 105.8 | | 74 | 77.2 |
| 17<'b> | 5.02 | 76 | 3.65 | | | | | 76 | 78.4 |
| 19<ax> | 4.57 | 78<ax> | 4.59 | | 19 | 96.4 | | 78 | 103.3 |
| 21<ax> | 3.15 | 80<ax> | 3.33 | | 21 | 77.6 | | 80 | 75.6 |
| 22<ax> | 3.12 | 81<'> | 3.66 | | 22 | 70.8 | | 81 | 62.7 |
| 23<ax> | 3.75 | 81<> | 3.37 | | 23 | 86.5 | | | |
| 24<ax> | 3.48 | 83<ax> | 3.06 | | 24 | 79.6 | | 83 | 71.3 |
| 26<ax> | 4.69 | 85<ax> | 3.18 | | 26 | 103 | | 85 | 77.2 |
| 28<ax> | 3.3 | 87<ax> | 3.05 | | 28 | 77.2 | | 87 | 75.1 |
| 29<'> | 3.71 | 89 | 0.73 | | 29 | 62.1 | | 89 | 17.1 |
| 29<> | 3.69 | 90 | 1.1 | | | | | 90 | 29.2 |

$^{13}$C NMR (201 MHz, $DMSO$-$d_6$) δ ppm 17.1, 19.9, 20.6, 22.7, 29.2, 37.7, 38.3, 40.3, 40.8, 42.1, 42.2, 44.4, 44.8, 47.4, 54.0, 57.4, 61.6, 61.9, 62.0, 62.1, 62.7, 69.1, 69.3, 70.3, 70.8, 70.8, 71.3, 71.5, 74.2, 74.4, 75.1, 75.4, 75.6, 76.9, 77.2, 77.2, 77.2, 77.2, 77.2, 77.2, 77.6, 77.8, 78.4, 79.6, 86.5, 88.4, 93.6, 96.4, 103.0, 103.3, 103.3, 103.9, 105.8, 153.2, 178.0

Figure 8R

Steviol+7Glc (isomer 2)

| No. | Atom1 | Shift1 (ppm) | H's | Type | J (Hz) | Multiplet1 | (ppm) |
|---|---|---|---|---|---|---|---|
| 1 | 100, 6<'> | 0.87 | 4 | s | - | M17 | [0.80 .. 0.93] |
| 2 | 7a | 0.99 | 1 | m | - | M18 | [0.96 .. 1.02] |
| 3 | 2<'> | 1.06 | 1 | m | - | M19 | [1.02 .. 1.09] |
| 4 | 4 | 1.12 | 1 | m | - | M20 | [1.09 .. 1.15] |
| 5 | 101 | 1.24 | 3 | s | - | M21 | [1.17 .. 1.30] |
| 6 | 1<'>, 9<'> | 1.44 | 2 | br s | - | M22 | [1.38 .. 1.47] |
| 7 | 9<''>, 14<'>, 13<'>, 11<> | 1.56 | 4 | m | - | M23 | [1.47 .. 1.65] |
| 8 | 10<> | 1.70 | 1 | m | - | M24 | [1.65 .. 1.75] |
| 9 | 14<''>, 1<''>, 6<''>, 13<''>, 10<''> | 1.88 | 5 | br d | 10.51 | M25 | [1.76 .. 1.99] |
| 10 | 16<> | 2.05 | 1 | m | - | M26 | [2.00 .. 2.09] |
| 11 | 16<''>, 11<''> | 2.16 | 2 | m | - | M27 | [2.10 .. 2.22] |
| 12 | 2<''> | 2.26 | 1 | m | - | M28 | [2.23 .. 2.30] |
| 13 | 31<ax> | 3.14 | 1 | br t | 9.41 | M16 | [3.10 .. 3.17] |
| 14 | 98<ax>, 35<ax>, 94<ax>, 53<ax> | 3.24 | 4 | m | - | M15 | [3.19 .. 3.30] |
| 15 | 40<ax>, 81<ax>, 78<ax>, 47<ax>, 85<ax>, 55<ax>, 91<ax>, 28<ax>, 56<ax>, 33<ax>, 96<ax>, 54< | 3.40 | 12 | m | - | M14 | [3.32 .. 3.47] |
| 16 | 45<ax>, 69<ax>, 21<ax>, 83<ax>, 43<ax> | 3.50 | 5 | m | - | M13 | [3.47 .. 3.54] |
| 17 | 29<'>, 72<ax>, 22<ax>, 58<'> | 3.58 | 4 | m | - | M12 | [3.54 .. 3.63] |
| 18 | 92<'>, 70<'>, 79<'>, 41<'>, 24<ax> | 3.69 | 5 | m | - | M11 | [3.63 .. 3.74] |
| 19 | 92<''>, 29<''>, 70<''>, 50<''>, 23<ax>, 79<''>, 41<''>, 58<''> | 3.86 | 8 | m | - | M10 | [3.77 .. 3.95] |
| 20 | 74<ax>, 87<ax>, 50<''> | 4.09 | 3 | m | - | M09 | [4.04 .. 4.16] |
| 21 | 52<ax> | 4.45 | 1 | d | 7.82 | M03 | [4.42 .. 4.49] |
| 22 | 19<ax> | 4.77 | 1 | br d | 8.07 | M08 | [4.76 .. 4.77] |
| 23 | 38<ax> | 4.78 | 1 | br d | 8.07 | M07 | [4.78 .. 4.79] |
| 24 | 76<ax> | 4.80 | 1 | br d | 8.07 | M06 | [4.79 .. 4.81] |
| 25 | 26<ax> | 4.83 | 1 | br d | 7.83 | M05 | [4.81 .. 4.85] |
| 26 | 17<a>, 89<ax> | 4.91 | 2 | m | - | M04 | [4.88 .. 4.95] |
| 27 | 17<b> | 5.13 | 1 | br s | - | M02 | [5.09 .. 5.17] |
| 28 | 67<ax> | 5.61 | 1 | d | 7.83 | M01 | [5.58 .. 5.63] |

$^1$H NMR (800 MHz, *DEUTERIUM OXIDE*) δ ppm 0.87 (s, 4 H) 0.96 - 1.02 (m, 1 H) 1.02 - 1.09 (m, 1 H) 1.09 - 1.15 (m, 1 H) 1.24 (s, 3 H) 1.44 (br s, 2 H) 1.47 - 1.65 (m, 4 H) 1.65 - 1.75 (m, 1 H) 1.88 (br d, J=10.51 Hz, 5 H) 2.00 - 2.09 (m, 1 H) 2.10 - 2.22 (m, 2 H) 2.23 - 2.30 (m, 1 H) 3.14 (br t, J=9.41 Hz, 1 H) 3.19 - 3.30 (m, 4 H) 3.32 - 3.47 (m, 12 H) 3.47 - 3.54 (m, 5 H) 3.54 - 3.63 (m, 4 H) 3.63 - 3.74 (m, 5 H) 3.77 - 3.95 (m, 8 H) 4.04 - 4.16 (m, 3 H) 4.45 (d, J=7.82 Hz, 1 H) 4.77 (br d, J=8.07 Hz, 1 H) 4.78 (br d, J=8.07 Hz, 1 H) 4.80 (br d, J=8.07 Hz, 1 H) 4.83 (br d, J=7.83 Hz, 1 H) 4.88 - 4.95 (m, 2 H) 5.13 (br s, 1 H) 5.61 (d, J=7.83 Hz, 1 H)

Steviol+7Glc (isomer 2)

ACD numbering

| F2 Atom | F2 (ppm) | F1 Atom | F1 (ppm) | F2 Atom | F2 (ppm) | F1 Atom | F1 (ppm) |
|---|---|---|---|---|---|---|---|
| 1<"> | 1.87 | 1 | 19.3 | 40<ax> | 3.44 | 40 | 76.2 |
| 1<> | 1.45 | | | 41<"> | 3.89 | 41 | 61.1 |
| 2<"> | 2.27 | 2 | 37.1 | 41<> | 3.7 | | |
| 2<> | 1.06 | | | 43<ax> | 3.51 | 43 | 69.9 |
| | | 3 | 44.3 | 45<ax> | 3.51 | 45 | 76.3 |
| 4 | 1.12 | 4 | 57.1 | 47<ax> | 3.35 | 47 | 73.8 |
| | | 5 | 39.8 | 50<"> | 4.1 | 50 | 68.9 |
| | | 6 | 40.3 | 50<> | 3.83 | | |
| 6<"> | 1.88 | | | 52<ax> | 4.46 | 52 | 103.1 |
| 6<> | 0.84 | | | 53<ax> | 3.28 | 53 | 73.5 |
| 7a | 0.99 | 7 | 53.5 | 54<ax> | 3.44 | 54 | 76.2 |
| | | 8 | 42 | 55<ax> | 3.39 | 55 | 69.9 |
| 9<"> | 1.55 | 9 | 41.5 | 56<ax> | 3.44 | 56 | 76.2 |
| 9<> | 1.44 | | | 58<"> | 3.89 | 58 | 61.1 |
| 10<"> | 1.91 | 10 | 22.1 | 58<> | 3.7 | | |
| 10<> | 1.7 | | | | | 64 | 178.8 |
| 11<"> | 2.15 | 11 | 44 | 67<ax> | 5.62 | 67 | 92.9 |
| 11<> | 1.5 | | | 69<ax> | 3.51 | 69 | 76.3 |
| | | 12 | 88.6 | 70<"> | 3.89 | 70 | 61.1 |
| 13<"> | 1.96 | 13 | 37.5 | 70<> | 3.7 | | |
| 13<> | 1.52 | | | 72<ax> | 3.54 | 72 | 68.5 |
| 14<"> | 1.81 | 14 | 20.3 | 74<ax> | 4.13 | 74 | 85.1 |
| 14<> | 1.6 | | | 76<ax> | 4.8 | 76 | 102.4 |
| | | 15 | 153.1 | 78<ax> | 3.39 | 78 | 76.6 |
| 16<"> | 2.19 | 16 | 47 | 79<"> | 3.89 | 79 | 61.1 |
| 16<> | 2.06 | | | 79<> | 3.7 | | |
| 17<a> | 4.91 | 17 | 104.9 | 81<ax> | 3.39 | 81 | 69.9 |
| 17<b> | 5.14 | | | 83<ax> | 3.51 | 83 | 76.3 |
| 19<ax> | 4.77 | 19 | 95.7 | 85<ax> | 3.37 | 85 | 73.8 |
| 21<ax> | 3.54 | 21 | 74.8 | 87<ax> | 4.07 | 87 | 76.3 |
| 22<ax> | 3.57 | 22 | 68.5 | 89<ax> | 4.92 | 89 | 101.9 |
| 23<ax> | 3.92 | 23 | 85.4 | 91<ax> | 3.39 | 91 | 76.6 |
| 24<ax> | 3.68 | 24 | 78.9 | 92<"> | 3.92 | 92 | 62 |
| 26<ax> | 4.84 | 26 | 102.4 | 92<> | 3.67 | | |
| 28<ax> | 3.39 | 28 | 76.6 | 94<ax> | 3.26 | 94 | 70.9 |
| 29<"> | 3.87 | 29 | 62 | 96<ax> | 3.44 | 96 | 76.2 |
| 29<> | 3.6 | | | 98<ax> | 3.22 | 98 | 74.2 |
| 31<ax> | 3.15 | 31 | 70.9 | 100 | 0.87 | 100 | 16.4 |
| 33<ax> | 3.44 | 33 | 76.2 | 101 | 1.25 | 101 | 28.6 |
| 35<ax> | 3.25 | 35 | 74.6 | | | | |
| 38<ax> | 4.79 | 38 | 102.4 | | | | |

$^{13}$C NMR (201 MHz, *DEUTERIUM OXIDE*) δ ppm 16.4, 19.3, 20.3, 22.1, 28.6, 37.1, 37.5, 39.8, 40.3, 41.5, 42.0, 44.0, 44.3, 47.0, 53.5, 57.1, 61.1, 61.1, 61.1, 61.1, 62.0, 68.5, 68.9, 69.9, 69.9, 70.9, 73.5, 73.8, 74.2, 74.6, 74.8, 76.2, 76.2, 76.2, 76.3, 76.3, 76.6, 76.6, 78.9, 85.1, 85.4, 88.6, 92.9, 95.7, 101.9, 102.4, 102.4, 103.1, 104.9, 153.1, 178.8

Figure 8V

Steviol+6Glc (isomer 4)

| Multiplet1 | Shift1 (ppm) | Atom1 | H's | Type | J (Hz) | (ppm) |
|---|---|---|---|---|---|---|
| M01 | 0.90 | 89, 6<*> | 4 | m | - | [0.85..0.93] |
| M02 | 1.04 | 7a | 1 | br d | 8.07 | [1.02..1.06] |
| M03 | 1.11 | 2<*> | 1 | m | - | [1.08..1.14] |
| M04 | 1.17 | 4 | 1 | br d | 12.47 | [1.15..1.20] |
| M05 | 1.28 | 90 | 3 | s | - | [1.25..1.30] |
| M06 | 1.49 | 11<*>, 9<*>, 1<*> | 3 | m | - | [1.45..1.54] |
| M51 | 1.57 | 13<*>, 9<*> | 2 | m | - | [1.54..1.61] |
| M07 | 1.64 | 14<*> | 1 | m | - | [1.61..1.67] |
| M08 | 1.74 | 10<*> | 1 | m | - | [1.71..1.78] |
| M35 | 1.85 | 14<*> | 1 | m | - | [1.83..1.87] |
| M09 | 1.89 | 6<*>, 10<*>, 1<*> | 3 | m | - | [1.83..1.94] |
| M10 | 1.98 | 13<*> | 1 | td | 12.10, 6.11 | [1.95..2.01] |
| M11 | 2.10 | 16<*> | 1 | br d | 17.12 | [2.08..2.13] |
| M12 | 2.20 | 11<*>, 16<*> | 2 | m | - | [2.18..2.24] |
| M13 | 2.30 | 2<*> | 1 | m | - | [2.28..2.33] |
| M42 | 3.24 | 31<ax> | 1 | m | - | [3.23..3.26] |
| M30 | 3.27 | 35<ax> | 1 | m | - | [3.26..3.29] |
| M14 | 3.32 | 87<ax>, 52<ax> | 2 | m | - | [3.29..3.34] |
| M28 | 3.36 | 83<ax> | 1 | m | - | [3.34..3.38] |
| M44 | 3.41 | 50<ax>, 40<ax> | 2 | m | - | [3.39..3.43] |
| M32 | 3.42 | 22<ax>, 58<ax> | 3 | m | - | [3.38..3.46] |
| M43 | 3.45 | 45<ax> | 1 | m | - | [3.44..3.46] |
| M33 | 3.47 | 33<ax>, 28<ax> | 2 | m | - | [3.46..3.48] |
| M27 | 3.48 | 48<ax>, 85<ax> | 3 | m | - | [3.38..3.57] |
| M31 | 3.51 | 72<ax> | 1 | m | - | [3.49..3.53] |
| M36 | 3.53 | 54<ax> | 1 | m | - | [3.51..3.55] |
| M34 | 3.55 | 80<ax> | 1 | m | - | [3.53..3.56] |
| M26 | 3.59 | 69<ax> | 1 | ddd | 9.72, 5.07, 2.32 | [3.57..3.61] |
| M25 | 3.66 | 29<*> | 1 | dd | 12.23, 7.09 | [3.64..3.68] |
| M18 | 3.73 | 24<ax>, 70<*>, 56<ax>, 81<*> | 4 | m | - | [3.68..3.79] |
| M47 | 3.74 | 46<*> | 1 | m | - | [3.71..3.77] |
| M49 | 3.76 | 61<*> | 1 | m | - | [3.74..3.78] |
| M37 | 3.85 | 74<ax> | 1 | m | - | [3.83..3.87] |
| M15 | 3.89 | 41<*>, 76<ax> | 2 | m | - | [3.82..3.96] |
| M40 | 3.90 | 23<ax>, 29<*> | 2 | m | - | [3.85..3.94] |
| M39 | 3.90 | 46<*>, 61<*> | 2 | m | - | [3.85..3.94] |
| M41 | 3.90 | 81<*> | 1 | m | - | [3.85..3.94] |
| M38 | 3.91 | 70<*> | 1 | m | - | [3.87..3.94] |
| M16 | 4.22 | 41<*> | 1 | br d | 9.54 | [4.20..4.24] |
| M17 | 4.50 | 43<ax> | 1 | d | 7.83 | [4.49..4.53] |
| M29 | 4.77 | 38<ax> | 1 | m | - | [4.75..4.78] |
| M19 | 4.79 | 19<ax> | 1 | d | 7.83 | [4.78..4.80] |
| M24 | 4.79 | 78<ax> | 1 | m | - | [4.78..4.80] |
| M20 | 4.88 | 26<ax> | 1 | d | 8.07 | [4.86..4.90] |
| M21 | 4.95 | 17<a> | 1 | s | - | [4.94..4.97] |
| M22 | 5.16 | 17<b> | 1 | br s | - | [5.14..5.18] |
| M23 | 5.61 | 67<ax> | 1 | d | 7.82 | [5.60..5.62] |

Steviol+6Glc (isomer 4)

$^1$H NMR (800 MHz, DEUTERIUM OXIDE) δ ppm 0.85 - 0.93 (m, 4 H) 1.04 (br d, J=8.07 Hz, 1 H) 1.08 - 1.14 (m, 1 H) 1.17 (br d, J=12.47 Hz, 1 H) 1.28 (s, 3 H) 1.45 - 1.54 (m, 3 H) 1.54 - 1.61 (m, 2 H) 1.61 - 1.67 (m, 1 H) 1.71 - 1.78 (m, 1 H) 1.83 - 1.87 (m, 1 H) 1.94 (m, 3 H) 1.98 (td, J=12.10, 6.11 Hz, 1 H) 2.10 (br d, J=17.12 Hz, 1 H) 2.18 - 2.24 (m, 2 H) 2.28 - 2.33 (m, 1 H) 3.23 - 3.26 (m, 1 H) 3.26 - 3.29 (m, 1 H) 3.29 - 3.34 (m, 2 H) 3.34 - 3.38 (m, 1 H) 3.38 - 3.57 (m, 3 H) 3.38 - 3.46 (m, 3 H) 3.39 - 3.43 (m, 2 H) 3.44 - 3.46 (m, 1 H) 3.46 - 3.48 (m, 2 H) 3.49 - 3.53 (m, 1 H) 3.51 - 3.55 (m, 1 H) 3.53 - 3.56 (m, 1 H) 3.59 (ddd, J=9.72, 5.07, 2.32 Hz, 1 H) 3.66 (dd, J=12.23, 7.09 Hz, 1 H) 3.68 - 3.79 (m, 4 H) 3.71 - 3.77 (m, 1 H) 3.74 - 3.78 (m, 1 H) 3.82 - 3.96 (m, 2 H) 3.83 - 3.87 (m, 1 H) 3.85 - 3.94 (m, 2 H) 3.85 - 3.94 (m, 2 H) 3.85 - 3.94 (m, 1 H) 3.87 - 3.94 (m, 1 H) 4.22 (br d, J=9.54 Hz, 1 H) 4.50 (d, J=7.83 Hz, 1 H) 4.75 - 4.78 (m, 1 H) 4.79 (d, J=7.83 Hz, 1 H) 4.78 - 4.80 (m, 1 H) 4.88 (d, J=8.07 Hz, 1 H) 4.95 (s, 1 H) 5.16 (br s, 1 H) 5.61 (d, J=7.82 Hz, 1 H)

$^{13}$C NMR (201 MHz, DEUTERIUM OXIDE) δ ppm 18.8, 21.8, 22.6, 24.2, 31.1, 39.6, 39.6, 42.0, 42.7, 43.7, 44.1, 46.8, 46.8, 49.5, 55.8, 59.5, 63.3, 63.5, 63.7, 64.3, 71.3, 71.5, 72.2, 72.3, 72.5, 72.8, 73.3, 75.9, 76.1, 77.0, 77.5, 78.0, 78.4, 78.4, 78.5, 78.6, 78.7, 78.7, 78.8, 79.0, 79.0, 79.3, 80.8, 81.3, 89.0, 90.5, 95.4, 98.4, 104.8, 105.2, 105.3, 105.3, 107.1, 155.9, 181.1

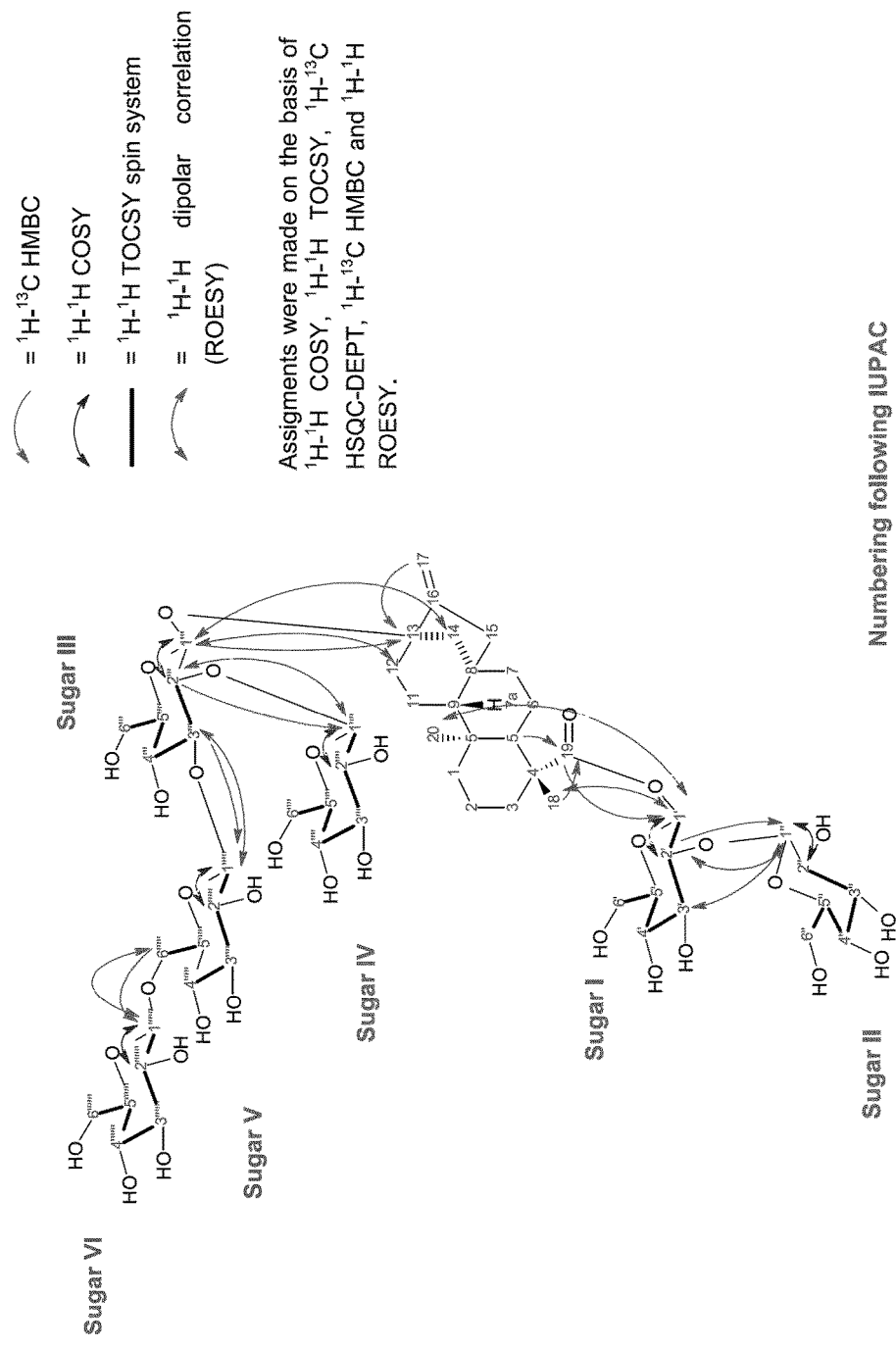

Figure 8Z

Steviol+7Glc (isomer 5)

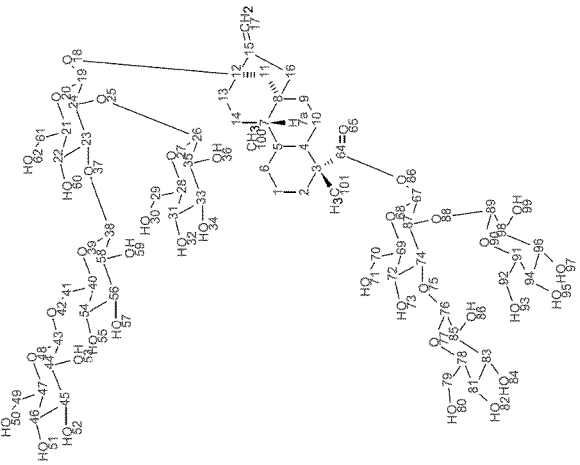

| Multiplet1 | Shift1 (ppm) | Atom1 | H's | Type | J (Hz) | (ppm) |
|---|---|---|---|---|---|---|
| M01 | 0.90 | 100, 6<'> | 4 | s | - | [0.86 .. 0.94] |
| M37 | 1.04 | 7a | 1 | br d | 7.83 | [1.01 .. 1.06] |
| M36 | 1.11 | 2<'> | 1 | m | - | [1.08 .. 1.14] |
| M35 | 1.17 | 4 | 1 | br d | 12.23 | [1.15 .. 1.20] |
| M02 | 1.28 | 101 | 3 | s | - | [1.25 .. 1.31] |
| M03 | 1.50 | 11<'>, 1<'>, 9<'> | 3 | m | - | [1.46 .. 1.53] |
| M04 | 1.57 | 13<'>, 9<''> | 2 | m | - | [1.54 .. 1.60] |
| M34 | 1.63 | 14<'> | 1 | m | - | [1.60 .. 1.67] |
| M33 | 1.72 | 10<'> | 1 | m | - | [1.67 .. 1.77] |
| M32 | 1.84 | 14<''> | 1 | br d | 9.29 | [1.81 .. 1.86] |
| M05 | 1.92 | 10<''>, 1<''>, 2<''> | 3 | m | - | [1.87 .. 1.96] |
| M31 | 2.00 | 13<''> | 1 | br d | 6.36 | [1.97 .. 2.04] |
| M30 | 2.11 | 16<'> | 1 | br d | 16.14 | [2.07 .. 2.14] |
| M29 | 2.20 | 16<''>, 11<''> | 2 | m | - | [2.17 .. 2.23] |
| M28 | 2.28 | 6<''> | 1 | br d | 12.72 | [2.25 .. 2.30] |
| M26 | 3.21 | 31<ax> | 1 | t | 9.29 | [3.19 .. 3.23] |
| M06 | 3.27 | 98<ax>, 35<ax> | 2 | q | 8.31 | [3.25 .. 3.30] |
| M27 | 3.32 | 44<ax>, 94<ax> | 2 | m | - | [3.30 .. 3.35] |
| M07 | 3.43 | 46<ax>, 21<ax>, 23<ax>, 58<ax>, 28<ax>, 91<ax>, 78<ax>, 83<ax>, 85<ax> | 9 | m | - | [3.39 .. 3.48] |
| M25 | 3.50 | 96<ax>, 33<ax>, 47<ax> | 3 | m | - | [3.48 .. 3.53] |
| M08 | 3.54 | 56<ax>, 81<ax>, 54<ax>, 45<ax> | 4 | m | - | [3.53 .. 3.56] |
| M09 | 3.62 | 69<ax>, 72<ax> | 2 | br d | 4.40 | [3.60 .. 3.64] |
| M24 | 3.66 | 29<'> | 1 | br dd | 12.23, 7.34 | [3.64 .. 3.68] |
| M10 | 3.73 | 70<'>, 40<ax>, 24<ax>, 61<'>, 79<'>, 92<'>, 49<'> | 7 | m | - | [3.69 .. 3.78] |
| M11 | 3.90 | 41<'>, 49<''>, 79<''>, 22<ax>, 70<''>, 92<''>, 61<''>, 29<''> | 8 | m | - | [3.83 .. 3.97] |
| M23 | 4.11 | 87<ax> | 1 | m | - | [4.09 .. 4.13] |
| M22 | 4.15 | 74<ax> | 1 | br d | 3.91 | [4.13 .. 4.17] |
| M21 | 4.23 | 41<''> | 1 | br d | 10.76 | [4.20 .. 4.25] |
| M19 | 4.50 | 43<ax> | 1 | d | 7.83 | [4.48 .. 4.52] |
| M18 | 4.77 | 38<ax> | 1 | br d | 7.83 | [4.75 .. 4.78] |
| M20 | 4.79 | 19<ax> | 1 | br d | 8.31 | [4.78 .. 4.80] |
| M16 | 4.81 | 76<ax> | 1 | br s | - | [4.81 .. 4.85] |
| M17 | 4.86 | 26<ax> | 1 | br d | 7.82 | [4.85 .. 4.88] |
| M15 | 4.95 | 17<a>, 89<ax> | 2 | m | - | [4.90 .. 4.98] |
| M14 | 5.16 | 17<b> | 1 | br s | - | [5.13 .. 5.20] |
| M13 | 5.63 | 67<ax> | 1 | d | 7.34 | [5.61 .. 5.66] |

Figure 8AA

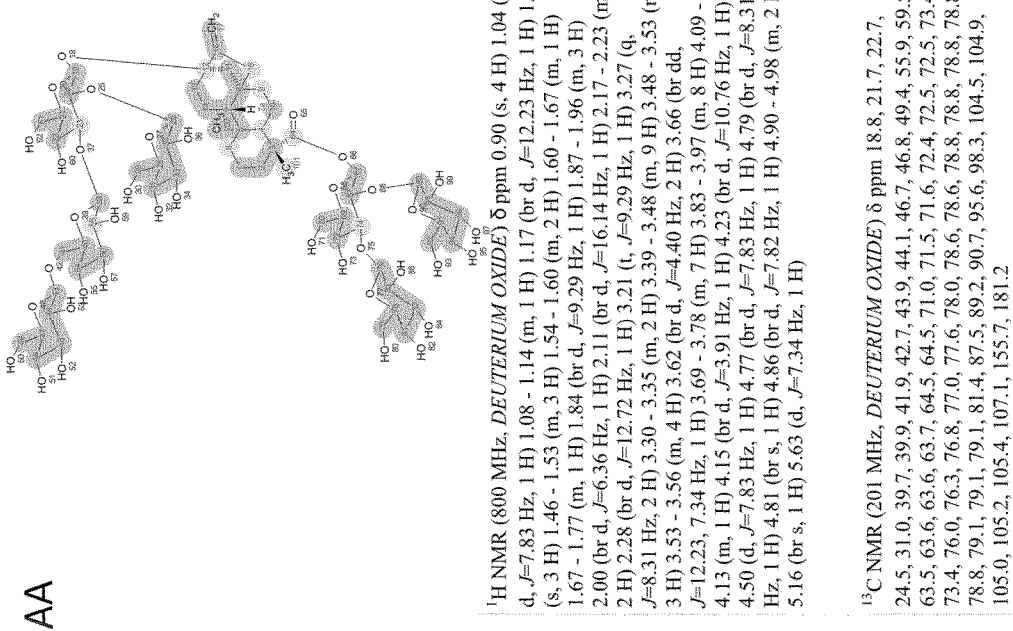

Steviol+7Glc (isomer 5)

| F2 Atom | F2 (ppm) | F1 Atom | F1 (ppm) |
|---|---|---|---|
| 1<'> | 1.9 | 1 | 21.7 |
| 1<> | 1.49 | | |
| 2<''> | 2.28 | 2 | 39.7 |
| 2<'> | 1.11 | | |
| | | 3 | 46.8 |
| 4 | 1.17 | 4 | 59.5 |
| | | 5 | 41.9 |
| 6<''> | 1.91 | 6 | 42.7 |
| 6<'> | 0.89 | | |
| 7a | 1.04 | 7 | 55.9 |
| | | 8 | 44.1 |
| 9<''> | 1.57 | 9 | 43.9 |
| 9<> | 1.48 | | |
| 10<''> | 1.94 | 10 | 24.5 |
| 10<'> | 1.72 | | |
| 11<''> | 2.2 | 11 | 46.7 |
| 11<'> | 1.51 | | |
| | | 12 | 90.7 |
| 13<''> | 2 | 13 | 39.9 |
| 13<'> | 1.56 | | |
| 14<''> | 1.84 | 14 | 22.7 |
| 14<'> | 1.63 | | |
| | | 15 | 155.7 |
| 16<''> | 2.2 | 16 | 49.4 |
| 16<'> | 2.11 | | |
| 17<a> | 4.95 | 17 | 107.1 |
| 17<b> | 5.16 | | |
| 19<ax> | 4.79 | 19 | 98.3 |
| 21<ax> | 3.72 | 21 | 77.6 |

| | | | |
|---|---|---|---|
| 22<ax> | 3.54 | 22 | 71.5 |
| 23<ax> | 3.93 | 23 | 89.2 |
| 24<ax> | 3.71 | 24 | 81.4 |
| 26<ax> | 4.87 | 26 | 105 |
| 28<ax> | 3.47 | 28 | 78.8 |
| 29<''> | 3.9 | 29 | 64.5 |
| 29<'> | 3.65 | | |
| 31<ax> | 3.21 | 31 | 73.4 |
| 33<ax> | 3.39 | 33 | 78 |
| 35<ax> | 3.27 | 35 | 77 |
| 38<ax> | 4.77 | 38 | 105.2 |
| 40<ax> | 3.47 | 40 | 78.8 |
| 41<'> | 4.23 | 41 | 71.6 |
| 41<> | 3.87 | | |
| 43<ax> | 4.5 | 43 | 105.4 |
| 44<ax> | 3.33 | 44 | 76 |
| 45<ax> | 3.55 | 45 | 78.8 |
| 46<ax> | 3.41 | 46 | 72.5 |
| 47<ax> | 3.5 | 47 | 78.6 |
| 49<''> | 3.92 | 49 | 63.6 |
| 49<'> | 3.95 | | |
| 54<ax> | 3.51 | 54 | 72.4 |
| 56<ax> | 3.5 | 56 | 78.6 |
| 58<ax> | 3.42 | 58 | 79.1 |
| 61<''> | 3.73 | 61 | 63.7 |
| 61<'> | 3.85 | | |
| 67<ax> | 5.63 | 64 | 181.2 |
| 69<ax> | 3.62 | 67 | 95.6 |
| 70<''> | 3.74 | 69 | 79.1 |
| 70<'> | 3.73 | 70 | 63.6 |

$^1$H NMR (800 MHz, DEUTERIUM OXIDE) δ ppm 0.90 (s, 4 H) 1.04 (br d, J=7.83 Hz, 1 H) 1.08 - 1.14 (m, 1 H) 1.17 (br d, J=12.23 Hz, 1 H) 1.28 (s, 3 H) 1.46 - 1.53 (m, 3 H) 1.54 - 1.60 (m, 2 H) 1.60 - 1.67 (m, 1 H) 1.67 - 1.77 (m, 1 H) 1.84 (br d, J=9.29 Hz, 1 H) 1.87 - 1.96 (m, 3 H) 2.00 (br d, J=6.36 Hz, 1 H) 2.11 (br d, J=16.14 Hz, 1 H) 2.17 - 2.23 (m, 2 H) 2.28 (br d, J=12.72 Hz, 1 H) 3.21 (t, J=9.29 Hz, 1 H) 3.27 (q, J=8.31 Hz, 2 H) 3.30 - 3.35 (m, 2 H) 3.39 - 3.48 (m, 9 H) 3.48 - 3.53 (m, 3 H) 3.53 - 3.56 (m, 4 H) 3.62 (br d, J=4.40 Hz, 2 H) 3.66 (br dd, J=12.23, 7.34 Hz, 1 H) 3.69 - 3.78 (m, 7 H) 3.83 - 3.97 (m, 8 H) 4.09 - 4.13 (m, 1 H) 4.15 (br d, J=3.91 Hz, 1 H) 4.23 (br d, J=10.76 Hz, 1 H) 4.50 (d, J=7.83 Hz, 1 H) 4.77 (br d, J=7.83 Hz, 1 H) 4.79 (br d, J=8.31 Hz, 1 H) 4.81 (br s, 1 H) 4.86 (br d, J=7.82 Hz, 1 H) 4.90 - 4.98 (m, 2 H) 5.16 (br s, 1 H) 5.63 (d, J=7.34 Hz, 1 H)

$^{13}$C NMR (201 MHz, DEUTERIUM OXIDE) δ ppm 18.8, 21.7, 22.7, 24.5, 31.0, 39.7, 39.9, 41.9, 42.7, 43.9, 44.1, 46.7, 46.8, 49.4, 55.9, 59.5, 63.5, 63.6, 63.6, 63.7, 64.5, 71.0, 71.5, 71.6, 72.4, 72.5, 73.4, 73.4, 76.0, 76.3, 76.8, 77.0, 77.6, 78.0, 78.6, 78.8, 78.8, 78.8, 78.8, 79.1, 79.1, 81.4, 87.5, 89.2, 90.7, 95.6, 98.3, 104.5, 104.9, 105.0, 105.2, 105.4, 107.1, 155.7, 181.2

Steviol+7Glc (isomer 5)

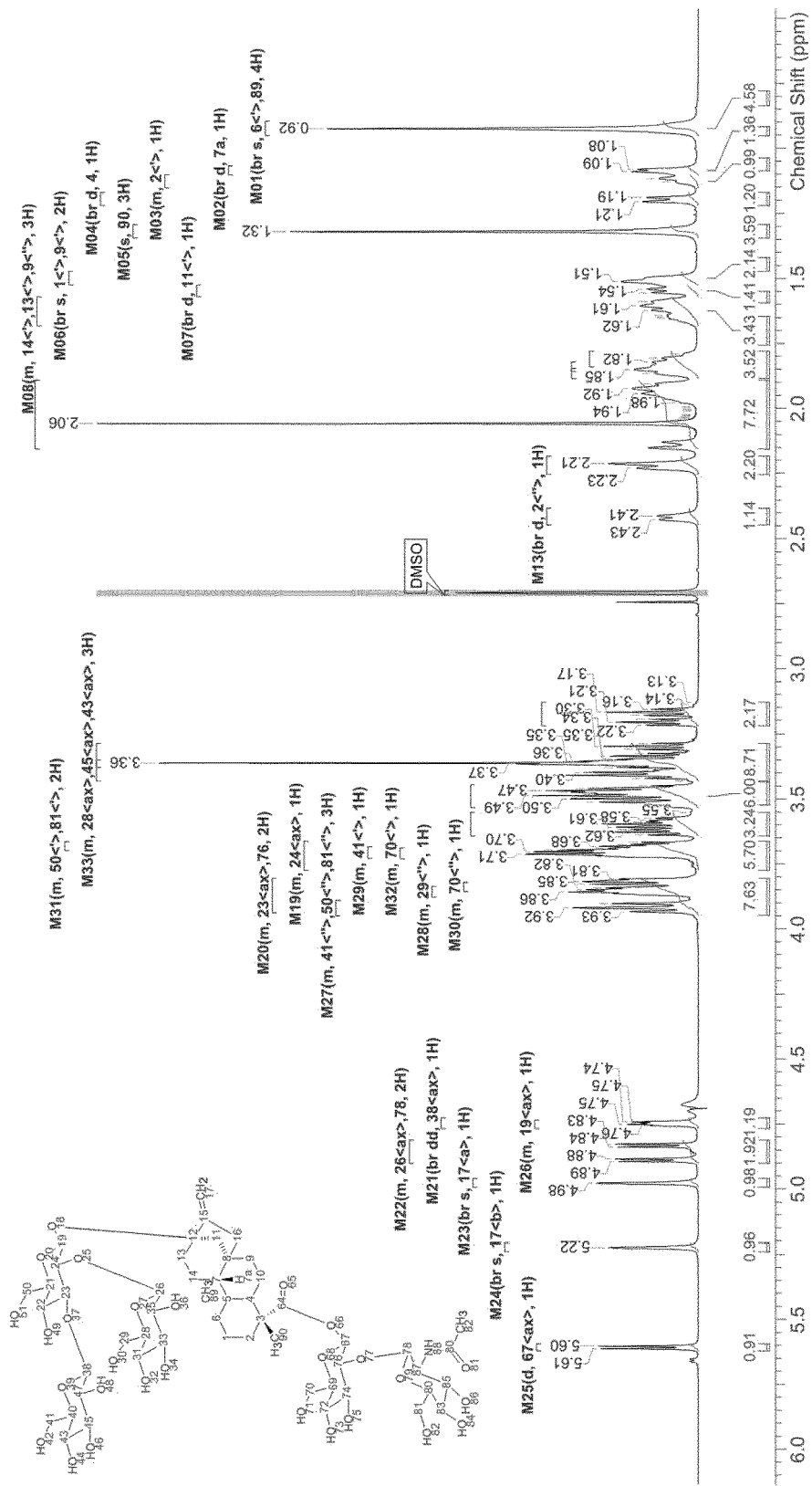

Figure 8AD

Steviol+4Glc+1GlcNAc (#11)

| Multiplet1 | Shift1 (ppm) | Atom1 | H's | Type | J (Hz) | (ppm) |
|---|---|---|---|---|---|---|
| M25 | 5.61 | 67<ax> | 1 | d | 7.43 | [5.60 .. 5.62] |
| M24 | 5.22 | 17<b> | 1 | br s | - | [5.21 .. 5.24] |
| M23 | 4.98 | 17<a> | 1 | br s | - | [4.96 .. 4.99] |
| M22 | 4.86 | 26<ax>, 78 | 2 | m | - | [4.81 .. 4.90] |
| M26 | 4.75 | 19<ax> | 1 | m | - | [4.73 .. 4.77] |
| M21 | 4.75 | 38<ax> | 1 | br dd | 7.63, 4.11 | [4.73 .. 4.77] |
| M27 | 3.92 | 41<'>, 50<">, 81<'> | 3 | m | - | [3.89 .. 3.95] |
| M20 | 3.86 | 23<ax>, 76 | 2 | m | - | [3.80 .. 3.94] |
| M28 | 3.86 | 29<'> | 1 | m | - | [3.84 .. 3.88] |
| M30 | 3.84 | 70<'> | 1 | m | - | [3.82 .. 3.86] |
| M32 | 3.71 | 70<'> | 1 | m | - | [3.69 .. 3.73] |
| M29 | 3.71 | 41<'> | 1 | m | - | [3.68 .. 3.73] |
| M31 | 3.70 | 24<ax> | 1 | m | - | [3.66 .. 3.77] |
| M31 | 3.68 | 50<'>, 81<'> | 2 | m | - | [3.67 .. 3.70] |
| M18 | 3.61 | 29<'>, 74, 87<ax> | 3 | m | - | [3.55 .. 3.64] |
| M17 | 3.48 | 21<ax>, 40<ax>, 85<ax>, 72<ax>, 69<ax>, 22 | 6 | m | - | [3.45 .. 3.53] |
| M34 | 3.40 | 80<ax>, 33<ax> | 2 | m | - | [3.38 .. 3.42] |
| M33 | 3.36 | 28<ax>, 45<ax>, 43<ax> | 3 | m | - | [3.35 .. 3.38] |
| M16 | 3.36 | 83<ax>, 47<ax> | 2 | m | - | [3.29 .. 3.43] |
| M15 | 3.19 | 31<ax>, 35<ax> | 2 | m | - | [3.13 .. 3.22] |
| M13 | 2.42 | 2<'> | 1 | br d | 12.52 | [2.38 .. 2.45] |
| M12 | 2.22 | 11<'>, 16<'> | 2 | br d | 13.69 | [2.18 .. 2.25] |
| M11 | 2.03 | 10<'>, 13<'>, 16<'>, 6<'>, 82 | 7 | m | - | [1.89 .. 2.16] |
| M10 | 1.86 | 14<'> | 1 | br d | 10.95 | [1.85 .. 1.89] |
| M35 | 1.84 | 1<'> | 1 | m | - | [1.82 .. 1.86] |
| M09 | 1.81 | 10<'> | 1 | m | - | [1.78 .. 1.84] |
| M08 | 1.62 | 14<'>, 13<'>, 9<'> | 3 | m | - | [1.57 .. 1.68] |
| M07 | 1.55 | 11<'> | 1 | br d | 10.95 | [1.53 .. 1.57] |
| M06 | 1.51 | 1<'>, 9<'> | 2 | br s | - | [1.47 .. 1.53] |
| M05 | 1.32 | 90 | 3 | s | - | [1.29 .. 1.34] |
| M04 | 1.20 | 4 | 1 | br d | 12.13 | [1.17 .. 1.22] |
| M03 | 1.12 | 2<'> | 1 | m | - | [1.10 .. 1.15] |
| M02 | 1.09 | 7a | 1 | br d | 7.82 | [1.07 .. 1.10] |
| M01 | 0.92 | 6<'>, 89 | 4 | br s | - | [0.90 .. 0.95] |

Homonuclear dipolar correlations between:
H-38 and H-23
H-26 and H-24
H-78 and H-76
H-67 and Me-90, Me-89
H-19 and H-11', H-13", H-16"
H-17a and H-16', H-16"
H-17b and H-13'
H-4 and H-7a, Me-90
Me-89 and H-11"
H-7a and H-16'

$^1$H NMR (800 MHz, Solvent) δ ppm 0.92 (br s, 4 H) 1.09 (br d, =7.82 Hz, 1 H) 1.10 - 1.15 (m, 1 H) 1.20 (br d, =12.13 Hz, 1 H) 1.32 (s, 3 H) 1.51 (br s, 2 H) 1.55 (br d, =10.95 Hz, 1 H) 1.57 - 1.68 (m, 3 H) 1.78 - 1.84 (m, 1 H) 1.82 - 1.86 (m, 1 H) 1.86 (br d, =10.95 Hz, 1 H) 1.89 - 2.16 (m, 7 H) 2.22 (br d, =13.69 Hz, 2 H) 2.42 (br d, =12.52 Hz, 1 H) 3.13 - 3.22 (m, 2 H) 3.29 - 3.43 (m, 2 H) 3.35 - 3.38 (m, 3 H) 3.38 - 3.42 (m, 2 H) 3.45 - 3.53 (m, 6 H) 3.55 - 3.64 (m, 3 H) 3.66 - 3.77 (m, 1 H) 3.67 - 3.70 (m, 2 H) 3.68 - 3.73 (m, 1 H) 3.69 - 3.73 (m, 1 H) 3.80 - 3.94 (m, 2 H) 3.82 - 3.86 (m, 1 H) 3.84 - 3.88 (m, 1 H) 3.89 - 3.95 (m, 3 H) 4.75 (br dd, =7.63, 4.11 Hz, 1 H) 4.73 - 4.77 (m, 1 H) 4.81 - 4.90 (m, 2 H) 4.98 (br s, 1 H) 5.22 (br s, 1 H) 5.61 (d, =7.43 Hz, 1 H)

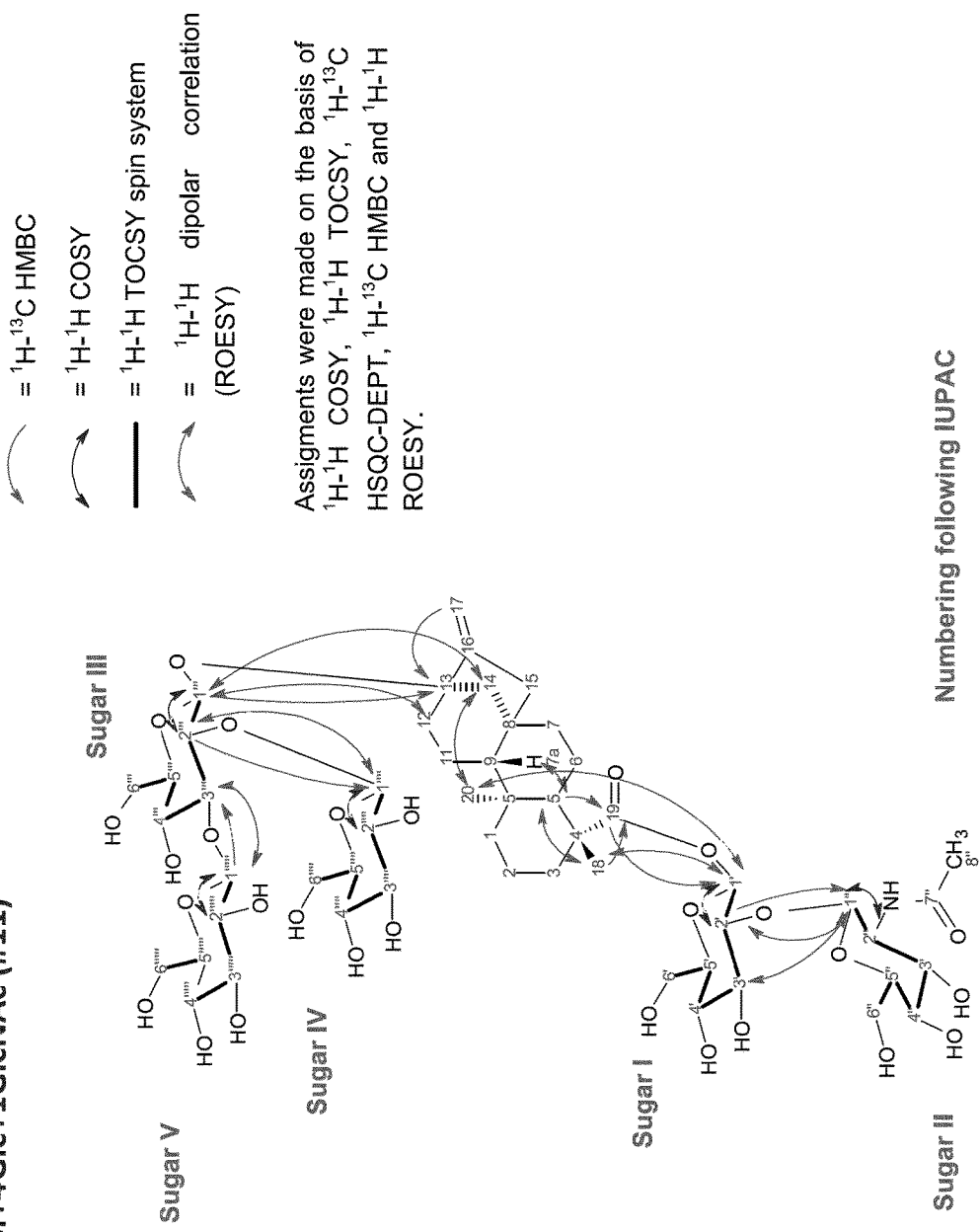

Figure 8AH

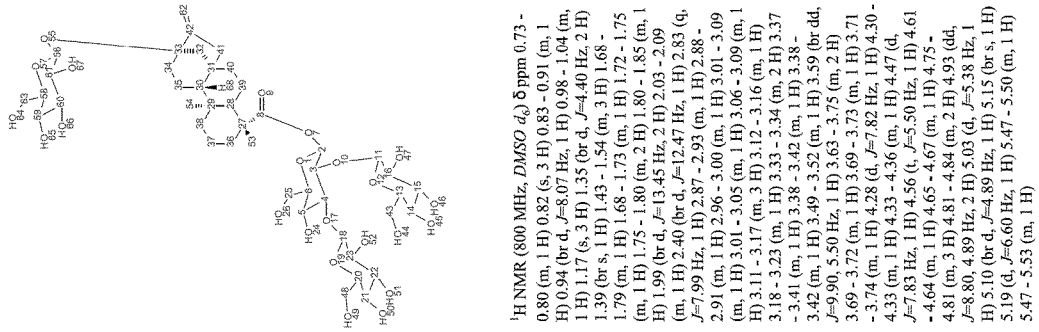

Steviol+4Glc (#26)

| Multiplet | Shift (ppm) | Atom1 | H's | Type | J (Hz) | (ppm) |
|---|---|---|---|---|---|---|
| M35 | 5.50 | 2<ax> | 1 | m | - | [5.47 .. 5.53] |
| M46 | 5.49 | 52 | 1 | m | - | [5.47 .. 5.50] |
| M34 | 5.19 | 47 | 1 | d | 6.60 | [5.16 .. 5.21] |
| M33 | 5.15 | 62<b> | 1 | br s | - | [5.13 .. 5.16] |
| M32 | 5.10 | 51 | 1 | br d | 4.89 | [5.08 .. 5.13] |
| M31 | 5.03 | 50 | 1 | d | 5.38 | [5.00 .. 5.06] |
| M30 | 4.93 | 45, 46 | 2 | dd | 8.80, 4.89 | [4.90 .. 4.97] |
| M58 | 4.83 | 65, 67 | 2 | m | - | [4.81 .. 4.84] |
| M29 | 4.78 | 66, 11<ax>, 62<a> | 3 | m | - | [4.75 .. 4.81] |
| M59 | 4.66 | 24 | 1 | m | - | [4.65 .. 4.67] |
| M62 | 4.63 | 44 | 1 | m | - | [4.61 .. 4.64] |
| M27 | 4.56 | 26 | 1 | t | 5.50 | [4.54 .. 4.58] |
| M26 | 4.47 | 18<ax> | 1 | d | 7.83 | [4.44 .. 4.50] |
| M61 | 4.34 | 64 | 1 | m | - | [4.33 .. 4.36] |
| M60 | 4.31 | 49 | 1 | m | - | [4.30 .. 4.33] |
| M25 | 4.28 | 56<ax> | 1 | d | 7.82 | [4.26 .. 4.30] |
| M38 | 3.73 | 63<'> | 1 | m | - | [3.71 .. 3.74] |
| M36 | 3.71 | 48<'> | 1 | m | - | [3.69 .. 3.73] |
| M21 | 3.71 | 4<ax> | 1 | m | - | [3.69 .. 3.72] |
| M24 | 3.70 | 25<'>, 3<ax> | 2 | m | - | [3.63 .. 3.75] |
| M23 | 3.59 | 43<'> | 1 | br dd | 9.90, 5.50 | [3.56 .. 3.62] |
| M22 | 3.50 | 25<'> | 1 | m | - | [3.49 .. 3.52] |
| M47 | 3.40 | 43<'> | 1 | m | - | [3.38 .. 3.42] |
| M37 | 3.40 | 48<'> | 1 | m | - | [3.38 .. 3.42] |
| M39 | 3.39 | 63<'> | 1 | m | - | [3.37 .. 3.41] |
| M28 | 3.33 | 6<ax>, 5<ax> | 2 | m | - | [3.33 .. 3.34] |

| Multiplet | Shift (ppm) | Atom1 | H's | Type | J (Hz) | (ppm) |
|---|---|---|---|---|---|---|
| M20 | 3.21 | 20<ax> | 1 | m | - | [3.18 .. 3.23] |
| M19 | 3.14 | 60<ax>, 15<ax>, 22<ax> | 3 | m | - | [3.11 .. 3.17] |
| M48 | 3.14 | 13<ax> | 1 | m | - | [3.12 .. 3.16] |
| M40 | 3.07 | 21<ax> | 1 | m | - | [3.06 .. 3.09] |
| M18 | 3.05 | 23<ax> | 1 | m | - | [3.01 .. 3.09] |
| M41 | 3.03 | 59<ax> | 1 | m | - | [3.01 .. 3.05] |
| M17 | 2.98 | 58<ax> | 1 | m | - | [2.96 .. 3.00] |
| M16 | 2.90 | 61<ax> | 1 | m | - | [2.87 .. 2.93] |
| M42 | 2.90 | 14<ax> | 1 | m | - | [2.88 .. 2.91] |
| M15 | 2.83 | 16<ax> | 1 | q | 7.99 | [2.81 .. 2.85] |
| M14 | 2.40 | 36<'> | 1 | br d | 12.47 | [2.38 .. 2.43] |
| M13 | 2.06 | 41<'> | 1 | m | - | [2.03 .. 2.09] |
| M12 | 1.99 | 32<'>, 41<'> | 2 | br d | 13.45 | [1.96 .. 2.03] |
| M11 | 1.82 | 34<'> | 1 | m | - | [1.80 .. 1.85] |
| M45 | 1.78 | 39 | 2 | m | - | [1.75 .. 1.80] |
| M10 | 1.75 | 38<'> | 1 | m | - | [1.68 .. 1.79] |
| M43 | 1.74 | 37<'> | 1 | m | - | [1.72 .. 1.75] |
| M44 | 1.71 | 35<'> | 1 | m | - | [1.68 .. 1.73] |
| M09 | 1.49 | 35<'>, 40<'>, 32<'> | 3 | m | - | [1.43 .. 1.54] |
| M08 | 1.39 | 34<'> | 1 | br s | - | [1.37 .. 1.42] |
| M07 | 1.35 | 37<'>, 40<'> | 2 | br d | 4.40 | [1.31 .. 1.37] |
| M06 | 1.17 | 53 | 3 | s | - | [1.14 .. 1.19] |
| M05 | 1.01 | 28 | 1 | m | - | [0.98 .. 1.04] |
| M04 | 0.94 | 68 | 1 | br d | 8.07 | [0.92 .. 0.96] |
| M03 | 0.89 | 36<'> | 1 | m | - | [0.83 .. 0.91] |
| M02 | 0.82 | 54 | 3 | s | - | [0.80 .. 0.83] |
| M01 | 0.77 | 38<'> | 1 | m | - | [0.73 .. 0.80] |

$^1$H NMR (800 MHz, DMSO $d_6$) δ ppm 0.73 - 0.80 (m, 1 H) 0.82 (s, 3 H) 0.83 - 0.91 (m, 1 H) 0.94 (br d, J=8.07 Hz, 1 H) 0.98 - 1.04 (m, 1 H) 1.17 (s, 3 H) 1.35 (br d, J=4.40 Hz, 2 H) 1.39 (br s, 3 H) 1.43 - 1.54 (m, 3 H) 1.68 - 1.79 (m, 1 H) 1.68 - 1.73 (m, 1 H) 1.72 - 1.75 (m, 1 H) 1.75 - 1.80 (m, 2 H) 1.80 - 1.85 (m, 1 H) 1.99 (br d, J=13.45 Hz, 2 H) 2.03 - 2.09 (m, 1 H) 2.40 (br d, J=12.47 Hz, 1 H) 2.83 (q, J=7.99 Hz, 1 H) 2.87 - 2.93 (m, 1 H) 2.88 - 2.91 (m, 1 H) 2.96 - 3.00 (m, 1 H) 3.01 - 3.09 (m, 1 H) 3.01 - 3.05 (m, 1 H) 3.06 - 3.09 (m, 1 H) 3.11 - 3.17 (m, 3 H) 3.12 - 3.16 (m, 1 H) 3.18 - 3.23 (m, 1 H) 3.33 - 3.34 (m, 2 H) 3.37 - 3.41 (m, 1 H) 3.38 - 3.42 (m, 1 H) 3.38 - 3.42 (m, 1 H) 3.49 - 3.52 (m, 1 H) 3.59 (br dd, J=9.90, 5.50 Hz, 1 H) 3.63 - 3.75 (m, 2 H) 3.69 - 3.72 (m, 1 H) 3.69 - 3.73 (m, 1 H) 3.71 - 3.74 (m, 1 H) 4.28 (d, J=7.82 Hz, 1 H) 4.30 - 4.33 (m, 1 H) 4.33 - 4.36 (m, 1 H) 4.47 (d, J=7.83 Hz, 1 H) 4.56 (t, J=5.50 Hz, 1 H) 4.61 - 4.64 (m, 1 H) 4.65 - 4.67 (m, 1 H) 4.75 - 4.81 (m, 3 H) 4.81 - 4.84 (m, 2 H) 4.93 (dd, J=8.80, 4.89 Hz, 2 H) 5.03 (d, J=5.38 Hz, 1 H) 5.10 (br d, J=4.89 Hz, 1 H) 5.15 (br s, 1 H) 5.19 (d, J=6.60 Hz, 1 H) 5.47 - 5.50 (m, 1 H) 5.47 - 5.53 (m, 1 H)

Steviol+4Glc (#26)

| F2 Atom | δ(1H) (ppm) | F1 Atom | δ(13C) (ppm) |  |  |  |
|---|---|---|---|---|---|---|
| 2<ax> | 5.52 | 2 | 91.9 | 35<> | 1.5 |  |
| 3<ax> | 3.73 | 3 | 75.5 | 36<> | 2.4 | 36 | 36.6 |
| 4<ax> | 3.69 | 4 | 87 | 36<'> | 0.89 |  |  |
| 5<ax> | 3.34 | 5 | 68.3 | 37<'> | 1.74 | 37 | 19.5 |
| 6<ax> | 3.33 | 6 | 77.8 | 37<> | 1.35 |  |  |
|  |  | 8 | 174.9 | 38<'> | 1.78 | 38 | 40.2 |
|  |  |  |  | 38<> | 0.77 |  |  |
| 11<ax> | 4.79 | 11 | 101.8 | 39 | 1.78 | 39 | 21.4 |
| 13<ax> | 3.14 | 13 | 77.3 | 40<'> | 1.49 | 40 | 41.3 |
| 14<ax> | 2.89 | 14 | 71.4 | 40<> | 1.35 |  |  |
| 15<ax> | 3.14 | 15 | 77 | 41<'> | 2.06 | 41 | 47.8 |
| 16<ax> | 2.83 | 16 | 74.3 | 41<> | 2 |  |  |
| 18<ax> | 4.47 | 18 | 103.3 | 43<'> | 3.59 | 42 | 152.6 |
| 20<ax> | 3.21 | 20 | 77.3 | 43<> | 3.39 | 43 | 61.4 |
| 21<ax> | 3.07 | 21 | 70.3 | 48<'> | 3.4 |  |  |
| 22<ax> | 3.14 | 22 | 77 | 48<> | 3.71 | 48 | 61.3 |
| 23<ax> | 3.06 | 23 | 74 | 53 | 1.17 | 53 | 28.5 |
| 25<> | 3.65 | 25 | 60.7 | 54 | 0.82 | 54 | 16.4 |
| 25<'> | 3.5 |  |  | 56<ax> | 4.28 | 56 | 98.1 |
|  |  | 27 | 43.6 | 58<ax> | 2.98 | 58 | 76.9 |
| 28 | 1.01 | 28 | 56.7 | 59<ax> | 3.03 | 59 | 70.5 |
|  |  | 29 | 39.1 | 60<ax> | 3.14 | 60 | 77 |
|  |  | 31 | 41.6 | 61<ax> | 2.91 | 61 | 74 |
| 32<'> | 2 | 32 | 43.6 | 62<a> | 4.77 | 62 | 104.8 |
| 32<> | 1.48 |  |  | 62<b> | 5.15 |  |  |
|  |  | 33 | 85.8 | 63<'> | 3.73 | 63 | 62 |
| 34<'> | 1.82 | 34 | 37.9 | 63<> | 3.39 |  |  |
| 34<> | 1.39 |  |  | 68 | 0.94 | 30 | 53.4 |
| 35<'> | 1.7 | 35 | 20.1 |  |  |  |  |

$^{13}$C NMR (201 MHz, *DMSO d$_6$*) δ ppm 174.9 (1C), 152.6 (1C), 104.8 (1C), 103.3 (1C), 101.8 (1C), 98.1 (1C), 91.9 (1C), 87.0 (1C), 85.8 (1C), 77.8 (1C), 77.3 (2C), 77.0 (3C), 76.9 (1C), 75.5 (1C), 74.3 (1C), 74.0 (2C), 71.4 (1C), 70.5 (1C), 70.3 (1C), 68.3 (1C), 62.0 (1C), 61.4 (1C), 61.3 (1C), 60.7 (1C), 56.7 (1C), 53.4 (1C), 47.8 (1C), 43.6 (2C), 41.6 (1C), 41.3 (1C), 40.2 (1C), 39.1 (1C), 37.9 (1C), 36.6 (1C), 28.5 (1C), 21.4 (1C), 20.1 (1C), 19.5 (1C), 16.4 (1C)

Steviol+5Glc (#22)

Figure 8AL

Steviol+5Glc (#22)

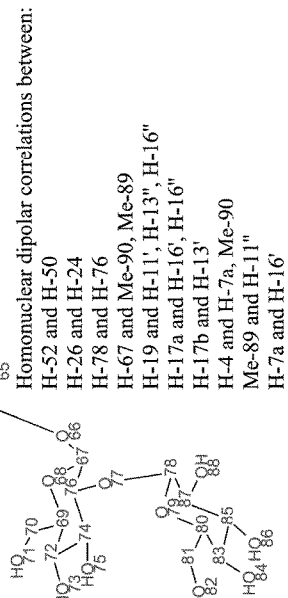

Homonuclear dipolar correlations between:
H-52 and H-50
H-26 and H-24
H-78 and H-76
H-67 and Me-90, Me-89
H-19 and H-11', H-13", H-16"
H-17a and H-16, H-16"
H-17b and H-13'
H-4 and H-7a, Me-90
Me-89 and H-11"
H-7a and H-16'

| Multiplet1 | Shift1 (ppm) | Atom1 | H's | Type | J (Hz) | (ppm) |
|---|---|---|---|---|---|---|
| M22 | 5.50 | 67<ax> | 1 | d | 7.82 | [5.49 .. 5.51] |
| M21 | 5.00 | 17<b> | 1 | br s | - | [4.99 .. 5.01] |
| M20 | 4.79 | 17<a> | 1 | s | - | [4.78 .. 4.81] |
| M19 | 4.65 | 19<ax> | 1 | d | 7.82 | [4.64 .. 4.67] |
| M23 | 4.62 | 78<ax> | 1 | m | - | [4.61 .. 4.64] |
| M32 | 4.59 | 26<ax> | 1 | m | - | [4.58 .. 4.61] |
| M18 | 4.34 | 52<ax> | 1 | d | 8.07 | [4.33 .. 4.35] |
| M17 | 3.97 | 50<'> | 1 | br d | 10.51 | [3.95 .. 3.98] |
| M25 | 3.76 | 81<'>, 58<''>, 29<''> | 3 | m | - | [3.72 .. 3.79] |
| M24 | 3.74 | 70<''>, 76<ax> | 2 | m | - | [3.72 .. 3.76] |
| M16 | 3.73 | 74<ax>, 50<'> | 2 | m | - | [3.66 .. 3.78] |
| M26 | 3.60 | 81<'>, 70<''>, 58<''> | 3 | m | - | [3.58 .. 3.62] |
| M15 | 3.57 | 29<''>, 23<ax> | 2 | m | - | [3.50 .. 3.62] |
| M14 | 3.34 | 85<ax>, 54<ax>, 33<ax>, 72<ax>, 21, 22, 69, 24<ax> | 8 | m | - | [3.24 .. 3.45] |
| M28 | 3.29 | 80<ax>, 56<ax>, 55<ax>, 28<ax> | 4 | m | - | [3.26 .. 3.32] |
| M27 | 3.20 | 83<ax> | 1 | m | - | [3.18 .. 3.21] |
| M13 | 3.16 | 87<ax>, 31<ax>, 53<ax>, 35<ax> | 4 | m | - | [3.11 .. 3.21] |
| M12 | 2.18 | 2<'> | 1 | br d | 13.20 | [2.16 .. 2.20] |
| M11 | 2.06 | 11<''>, 16<''> | 2 | m | - | [2.03 .. 2.09] |
| M10 | 1.93 | 16<''> | 1 | m | - | [1.90 .. 1.96] |
| M09 | 1.78 | 13<''>, 10<''>, 6<''> | 3 | m | - | [1.73 .. 1.84] |
| M29 | 1.71 | 1<''> | 1 | m | - | [1.67 .. 1.74] |
| M08 | 1.70 | 14<''> | 1 | br d | 10.51 | [1.67 .. 1.74] |
| M07 | 1.60 | 10<''> | 1 | m | - | [1.57 .. 1.64] |
| M06 | 1.46 | 13<''>, 9<''>, 14<''> | 3 | m | - | [1.40 .. 1.52] |
| M05 | 1.34 | 11<''>, 9<''>, 1<''> | 3 | m | - | [1.29 .. 1.38] |
| M04 | 1.13 | 90 | 3 | s | - | [1.10 .. 1.15] |
| M03 | 0.98 | 2<''>, 4 | 2 | m | - | [0.92 .. 1.04] |
| M02 | 0.89 | 7a | 1 | br d | 7.83 | [0.87 .. 0.91] |
| M01 | 0.75 | 6<''>, 89 | 4 | m | - | [0.71 .. 0.77] |

$^1$H NMR (800 MHz, DEUTERIUM OXIDE) δ ppm 0.71 - 0.77 (m, 4 H) 0.89 (br d, J=7.83 Hz, 1 H) 0.92 - 1.04 (m, 2 H) 1.13 (s, 3 H) 1.29 - 1.38 (m, 3 H) 1.40 - 1.52 (m, 3 H) 1.57 - 1.64 (m, 1 H) 1.70 (br d, J=10.51 Hz, 1 H) 1.67 - 1.74 (m, 1 H) 1.73 - 1.84 (m, 3 H) 1.90 - 1.96 (m, 1 H) 2.03 - 2.09 (m, 2 H) 2.18 (br d, J=13.20 Hz, 1 H) 3.11 - 3.21 (m, 4 H) 3.18 - 3.21 (m, 1 H) 3.24 - 3.45 (m, 8 H) 3.26 - 3.32 (m, 4 H) 3.50 - 3.62 (m, 2 H) 3.58 - 3.62 (m, 3 H) 3.66 - 3.78 (m, 2 H) 3.72 - 3.76 (m, 2 H) 3.72 - 3.79 (m, 3 H) 3.97 (br d, J=10.51 Hz, 1 H) 4.34 (d, J=8.07 Hz, 1 H) 4.58 - 4.61 (m, 1 H) 4.61 - 4.64 (m, 1 H) 4.65 (d, J=7.82 Hz, 1 H) 4.79 (s, 1 H) 5.00 (br s, 1 H) 5.50 (d, J=7.82 Hz, 1 H)

Figure 8AM

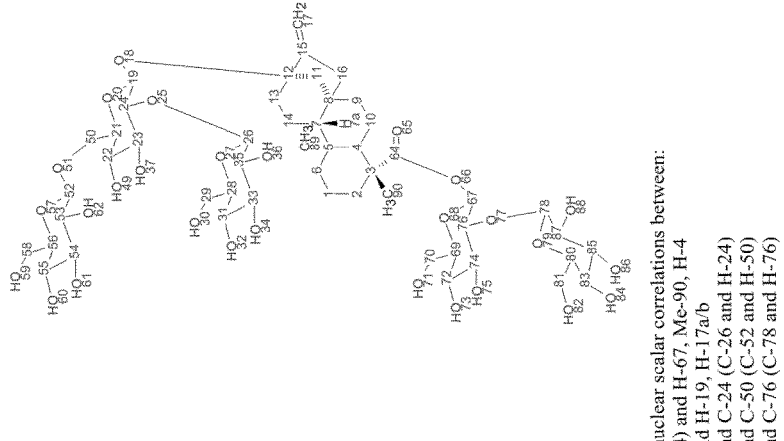

Heteronuclear scalar correlations between:
C=O(64) and H-67, Me-90, H-4
C-12 and H-19, H-17a/b
H-26 and C-24 (C-26 and H-24)
H-52 and C-50 (C-52 and H-50)
H-78 and C-76 (C-78 and H-76)

$^{13}$C NMR (201 MHz, *DEUTERIUM OXIDE*) δ ppm 178.0 (1C), 153.1 (1C), 104.3 (1C), 102.7 (1C), 102.5 (1C), 102.4 (1C), 95.5 (1C), 92.2 (1C), 87.4 (1C), 78.0 (1C), 76.4 (1C), 76.1 (2C), 76.0 (1C), 75.8 (2C), 75.3 (3C), 74.5 (2C), 74.1 (1C), 73.8 (1C), 72.9 (1C), 69.9 (1C), 69.7 (1C), 69.4 (1C), 69.0 (2C), 68.2 (1C), 61.0 (2C), 60.7 (2C), 60.4 (1C), 56.6 (1C), 52.9 (1C), 46.8 (1C), 44.0 (2C), 40.7 (1C), 39.8 (1C), 39.0 (1C), 36.6 (1C), 36.6 (1C), 28.4 (1C), 21.2 (1C), 19.9 (1C), 18.9 (1C), 15.8 (1C)

Steviol+5Glc (#22)

| F2 Atom | δ(1H) (ppm) | F1 Atom | δ(13C) (ppm) | .2 | | |
|---|---|---|---|---|---|---|
| 1<''> | 1.71 | 1 | 18.9 | 23<ax> | 3.36 | 69 |
| 1<'> | 1.32 | | | 24<ax> | 3.54 | 76 |
| 2<''> | 2.18 | 2 | 36.6 | 26<ax> | 3.41 | 74.5 |
| 2<'> | 0.95 | | | 28<ax> | 4.59 | 102.7 |
| | | 3 | 44 | 29<''> | 3.28 | 76.1 |
| 4 | 1.02 | 4 | 56.6 | 29<'> | 3.73 | 61 |
| | | 5 | 39 | 31<ax> | 3.52 | 61 |
| 6<''> | 1.76 | 6 | 39.8 | 33<ax> | 3.15 | 69.9 |
| 6<'> | 0.73 | | | 35<ax> | 3.35 | 75.3 |
| 7a | 0.89 | 7 | 52.9 | 50<''> | 3.16 | 74.1 |
| 9<''> | 1.44 | 9 | 40.7 | 50<'> | 3.97 | 68.2 |
| 9<'> | 1.33 | | | 52<ax> | 3.72 | 102.5 |
| 10<''> | 1.77 | 10 | 21.2 | 53<ax> | 4.34 | 72.9 |
| 10<'> | 1.6 | | | 54<ax> | 3.17 | 75.3 |
| 11<''> | 2.06 | 11 | 44 | 55<ax> | 3.35 | 69.4 |
| 11<'> | 1.36 | | | 56<ax> | 3.27 | 75.8 |
| | | 12 | 87.4 | 58<''> | 3.3 | 60.7 |
| 13<''> | 1.81 | 13 | 36.6 | 58<'> | 3.77 | |
| 13<'> | 1.42 | | | | 3.59 | |
| 14<''> | 1.71 | 14 | 19.9 | 64 | | 178 |
| 14<'> | 1.49 | | | 67<ax> | 5.5 | 92.2 |
| | | 15 | 153.1 | 69 | 3.44 | 76.4 |
| 16<''> | 2.07 | 16 | 46.8 | 70<''> | 3.73 | 60.4 |
| 16<'> | 1.93 | | | 70<'> | 3.6 | |
| 17a | 4.79 | 17 | 104.3 | 72<ax> | 3.36 | 69 |
| 17b | 5 | | | 74<ax> | 3.67 | 75.8 |
| 19<ax> | 4.65 | 19 | 95.5 | 76<ax> | 3.75 | 78 |
| 21 | 3.41 | 21 | 74.5 | 78<ax> | 4.62 | 102.4 |
| | | | | 80<ax> | 3.28 | 76.1 |
| | | | | 81<''> | 3.77 | 60.7 |
| | | | | 81<'> | 3.59 | |
| | | | | 83<ax> | 3.2 | 69.7 |

Figure 8AP

Steviol+7Glc (#14)

| Multiplet1 | Shift1 (ppm) | Atom1 | H's | Type | J (Hz) | (ppm) |
|---|---|---|---|---|---|---|
| M29 | 5.62 | 10<ax> | 1 | d | 7.83 | [5.60 .. 5.63] |
| M28 | 5.15 | 73<b> | 1 | br s | - | [5.13 .. 5.17] |
| M27 | 4.93 | 26<ax> | 1 | m | - | [4.91 .. 4.96] |
| M30 | 4.93 | 73<a> | 1 | m | - | [4.92 .. 4.94] |
| M31 | 4.85 | 85<ax> | 1 | br d | 7.83 | [4.83 .. 4.86] |
| M50 | 4.82 | 78<ax> | 1 | m | - | [4.81 .. 4.82] |
| M26 | 4.80 | 2<ax> | 1 | br d | 8.56 | [4.78 .. 4.81] |
| M45 | 4.78 | 67<ax> | 1 | m | - | [4.78 .. 4.79] |
| M25 | 4.51 | 19<ax> | 1 | d | 8.07 | [4.49 .. 4.53] |
| M24 | 4.23 | 17<'> | 1 | br d | 10.03 | [4.20 .. 4.25] |
| M23 | 4.12 | 8<ax>, 9<ax> | 2 | m | - | [4.08 .. 4.17] |
| M22 | 3.89 | 71<ax>, 43<'> | 2 | m | - | [3.81 .. 3.95] |
| M35 | 3.88 | 91<''>, 35<'> | 2 | m | - | [3.84 .. 3.93] |
| M33 | 3.88 | 38<''>, 17<'> | 2 | m | - | [3.84 .. 3.93] |
| M32 | 3.88 | 96<''> | 1 | m | - | [3.86 .. 3.90] |
| M34 | 3.83 | 74<'> | 1 | m | - | [3.82 .. 3.85] |
| M36 | 3.74 | 35<'> | 1 | m | - | [3.72 .. 3.76] |
| M46 | 3.71 | 91<'>, 74<'>, 38<'> | 3 | m | - | [3.69 .. 3.73] |
| M21 | 3.71 | 72<ax>, 6<ax>, 43<'> | 3 | m | - | [3.67 .. 3.75] |
| M20 | 3.62 | 96<'>, 12<ax>, 13<ax> | 3 | m | - | [3.59 .. 3.65] |
| M19 | 3.49 | 5<ax> | 1 | m | - | [3.44 .. 3.54] |
| M40 | 3.47 | 82<ax>, 70<ax>, 23<ax> | 3 | m | - | [3.39 .. 3.56] |

| | | | | | | |
|---|---|---|---|---|---|---|
| M41 | 3.47 | 89<ax>, 21<ax>, 4<ax>, 30<ax> | 4 | m | - | [3.39 .. 3.55] |
| M42 | 3.42 | 28<ax> | 1 | m | - | [3.41 .. 3.43] |
| M43 | 3.40 | 3<ax>, 87<ax> | 2 | m | - | [3.38 .. 3.42] |
| M37 | 3.40 | 81<ax> | 1 | m | - | [3.37 .. 3.43] |
| M18 | 3.39 | 83<ax>, 22<ax> | 2 | m | - | [3.36 .. 3.43] |
| M38 | 3.39 | 80<ax>, 69<ax> | 2 | m | - | [3.35 .. 3.43] |
| M17 | 3.28 | 24<ax>, 29<ax> | 2 | m | - | [3.23 .. 3.34] |
| M39 | 3.26 | 90<ax>, 31<ax> | 2 | m | - | [3.22 .. 3.29] |
| M16 | 3.18 | 88<ax> | 1 | m | - | [3.16 .. 3.21] |
| M15 | 2.26 | 57<'> | 1 | t | 9.41 | [2.22 .. 2.29] |
| M14 | 2.18 | 53<''>, 62<'> | 2 | br d | 12.23 | [2.15 .. 2.21] |
| M13 | 2.09 | 62<'> | 1 | m | - | [2.07 .. 2.11] |
| M12 | 1.99 | 55<'> | 1 | br d | 17.12 | [1.96 .. 2.02] |
| M47 | 1.92 | 60<''> | 1 | m | - | [1.89 .. 1.95] |
| M11 | 1.90 | 58<''>, 59<'> | 2 | m | - | [1.86 .. 1.95] |
| M10 | 1.82 | 56<'> | 1 | br d | 9.78 | [1.78 .. 1.86] |
| M09 | 1.70 | 60<'> | 1 | m | - | [1.67 .. 1.73] |
| M08 | 1.61 | 56<'> | 1 | m | - | [1.57 .. 1.65] |
| M07 | 1.54 | 55<'>, 61<''> | 2 | br s | - | [1.52 .. 1.57] |
| M06 | 1.48 | 58<'>, 61<'>, 53<'> | 3 | m | - | [1.42 .. 1.52] |
| M05 | 1.26 | 64 | 3 | s | - | [1.24 .. 1.28] |
| M04 | 1.16 | 49 | 1 | br d | 12.72 | [1.14 .. 1.20] |
| M03 | 1.10 | 57<'> | 1 | m | - | [1.06 .. 1.14] |
| M02 | 1.02 | 101 | 1 | br d | 7.58 | [0.96 .. 1.05] |
| M01 | 0.88 | 65 | 3 | s | - | [0.83 .. 0.93] |
| M44 | 0.87 | 59<'> | 1 | m | - | [0.84 .. 0.90] |

Homonuclear dipolar correlations between:
H-26 and H-9
H-2 and H-8
H-19 and H-17
H-85 and H-72
H-78 and H-71
H-10 and Me-65, Me-64
H-67 and H-53', H-55''
H-101 and H-49
H-49 and H-59', H-101, Me-64
Me-65 and H-60', H-53'', H-53' (indirect)
Me-64 and H-60''

$^1$H NMR (800 MHz, *DEUTERIUM OXIDE*) δ ppm 0.88 (s, 3 H) 0.84 - 0.90 (m, 1 H) 1.02 (br d, J=7.58 Hz, 1 H) 1.06 - 1.14 (m, 1 H) 1.16 (br d, J=12.72 Hz, 1 H) 1.26 (s, 3 H) 1.42 - 1.52 (m, 3 H) 1.54 (br s, 2 H) 1.57 - 1.65 (m, 1 H) 1.67 - 1.73 (m, 1 H) 1.82 (br d, J=9.78 Hz, 1 H) 1.86 - 1.95 (m, 2 H) 1.89 - 1.95 (m, 1 H) 1.96 - 2.02 (m, 1 H) 2.09 (br d, J=17.12 Hz, 1 H) 2.15 - 2.21 (m, 2 H) 2.26 (br d, J=12.23 Hz, 1 H) 3.18 (t, J=9.41 Hz, 1 H) 3.22 - 3.29 (m, 2 H) 3.23 - 3.34 (m, 2 H) 3.35 - 3.43 (m, 2 H) 3.36 - 3.43 (m, 2 H) 3.37 - 3.43 (m, 1 H) 3.38 - 3.42 (m, 2 H) 3.39 - 3.56 (m, 3 H) 3.39 - 3.55 (m, 4 H) 3.41 - 3.43 (m, 1 H) 3.44 - 3.54 (m, 1 H) 3.59 - 3.65 (m, 3 H) 3.67 - 3.75 (m, 3 H) 3.69 - 3.73 (m, 3 H) 3.72 - 3.76 (m, 1 H) 3.81 - 3.95 (m, 2 H) 3.82 - 3.85 (m, 1 H) 3.84 - 3.93 (m, 2 H) 3.84 - 3.93 (m, 2 H) 3.86 - 3.90 (m, 1 H) 4.08 - 4.17 (m, 2 H) 4.23 (br d, J=10.03 Hz, 1 H) 4.51 (d, J=8.07 Hz, 1 H) 4.78 - 4.79 (m, 1 H) 4.80 (br d, J=8.56 Hz, 1 H) 4.81 - 4.82 (m, 1 H) 4.85 (br d, J=7.83 Hz, 1 H) 4.91 - 4.96 (m, 1 H) 4.92 - 4.94 (m, 1 H) 5.15 (br s, 1 H) 5.62 (d, J=7.83 Hz, 1 H)

Figure 8AQ

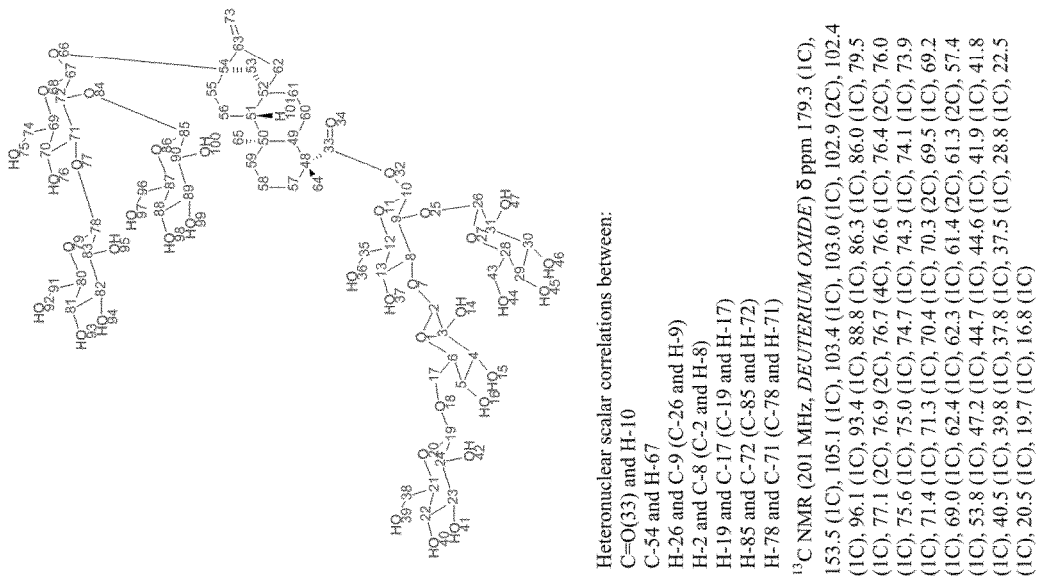

Steviol+7Glc (#14)

| F2 Atom | δ(1H) (ppm) | F1 Atom | δ(13C) (ppm) |
|---|---|---|---|
| 2<ax> | 4.8 | 2 | 102.9 |
| 3<ax> | 3.4 | 3 | 77.1 |
| 4<ax> | 3.52 | 4 | 76.7 |
| 5<ax> | 3.49 | 5 | 70.4 |
| 6<ax> | 3.71 | 6 | 75.6 |
| 8<ax> | 4.14 | 8 | 86.3 |
| 9<ax> | 4.1 | 9 | 76.6 |
| 10<ax> | 5.62 | 10 | 93.4 |
| 12<ax> | 3.61 | 12 | 76.9 |
| 13<ax> | 3.61 | 13 | 69 |
| 17<''> | 4.23 | 17 | 69.5 |
| 17<'> | 3.86 | | |
| 19<ax> | 4.51 | 19 | 103.4 |
| 21<ax> | 3.45 | 21 | 76.7 |
| 22<ax> | 3.39 | 22 | 70.3 |
| 23<ax> | 3.49 | 23 | 76.4 |
| 24<ax> | 3.32 | 24 | 73.9 |
| 26<ax> | 4.94 | 26 | 102.4 |
| 28<ax> | 3.41 | 28 | 76.9 |
| 29<ax> | 3.29 | 29 | 71.3 |
| 30<ax> | 3.45 | 30 | 76.7 |
| 31<ax> | 3.24 | 31 | 74.7 |
| | | 33 | 179.3 |
| 35<'> | 3.87 | 35 | 61.3 |
| 35<'> | 3.74 | | |
| 38<''> | 3.91 | | |
| 38<'> | 3.71 | 38 | 61.4 |
| 43<''> | 3.93 | 43 | 62.4 |
| 43<'> | 3.7 | | |

| | | | |
|---|---|---|---|
| 49 | 1.16 | 48 | 44.7 |
| | | 49 | 57.4 |
| | | 50 | 39.8 |
| | | 52 | 41.9 |
| 53<'> | 2.17 | 53 | 44.6 |
| 53<'> | 1.49 | | |
| | | 54 | 88.8 |
| 55<'> | 1.99 | 55 | 37.8 |
| 55<'> | 1.54 | | |
| 56<''> | 1.82 | 56 | 20.5 |
| 56<'> | 1.61 | | |
| 57<'> | 2.26 | 57 | 37.5 |
| 57<'> | 1.1 | | |
| 58<''> | 1.88 | 58 | 19.7 |
| 58<'> | 1.46 | | |
| 59<''> | 1.89 | 59 | 40.5 |
| 59<'> | 0.87 | | |
| 60<''> | 1.92 | 60 | 22.5 |
| 60<'> | 1.7 | | |
| 61<''> | 1.55 | 61 | 41.8 |
| 61<'> | 1.47 | | |
| 62<''> | 2.18 | 62 | 47.2 |
| 62<'> | 2.09 | | |
| | | 63 | 153.5 |
| 64 | 1.26 | 64 | 28.8 |
| 65 | 0.88 | 65 | 16.8 |
| 67<ax> | 4.78 | 67 | 96.1 |
| 69<ax> | 3.37 | 69 | 74.3 |
| 70<ax> | 3.5 | 70 | 69.2 |
| 71<ax> | 3.93 | 71 | 86 |
| 72<ax> | 3.68 | 72 | 79.5 |

Heteronuclear scalar correlations between:
C=O(33) and H-10
C-54 and H-67
H-26 and C-9 (C-26 and H-9)
H-2 and C-8 (C-2 and H-8)
H-19 and C-17 (C-19 and H-17)
H-85 and C-72 (C-85 and H-72)
H-78 and C-71 (C-78 and H-71)

$^{13}$C NMR (201 MHz, *DEUTERIUM OXIDE*) δ ppm 179.3 (1C), 153.5 (1C), 105.1 (1C), 103.4 (1C), 103.0 (1C), 102.9 (2C), 102.4 (1C), 96.1 (1C), 93.4 (1C), 88.8 (1C), 86.3 (1C), 86.0 (1C), 79.5 (1C), 77.1 (2C), 76.9 (2C), 76.7 (4C), 76.6 (1C), 76.4 (2C), 76.0 (1C), 75.6 (1C), 75.0 (1C), 74.7 (1C), 74.3 (1C), 74.1 (1C), 73.9 (1C), 71.4 (1C), 71.3 (1C), 70.4 (1C), 70.3 (2C), 69.5 (1C), 69.2 (1C), 69.0 (1C), 62.4 (1C), 62.3 (1C), 61.4 (2C), 61.3 (2C), 57.4 (1C), 53.8 (1C), 47.2 (1C), 44.7 (1C), 44.6 (1C), 41.9 (1C), 41.8 (1C), 40.5 (1C), 39.8 (1C), 37.8 (1C), 37.5 (1C), 28.8 (1C), 22.5 (1C), 20.5 (1C), 19.7 (1C), 16.8 (1C)

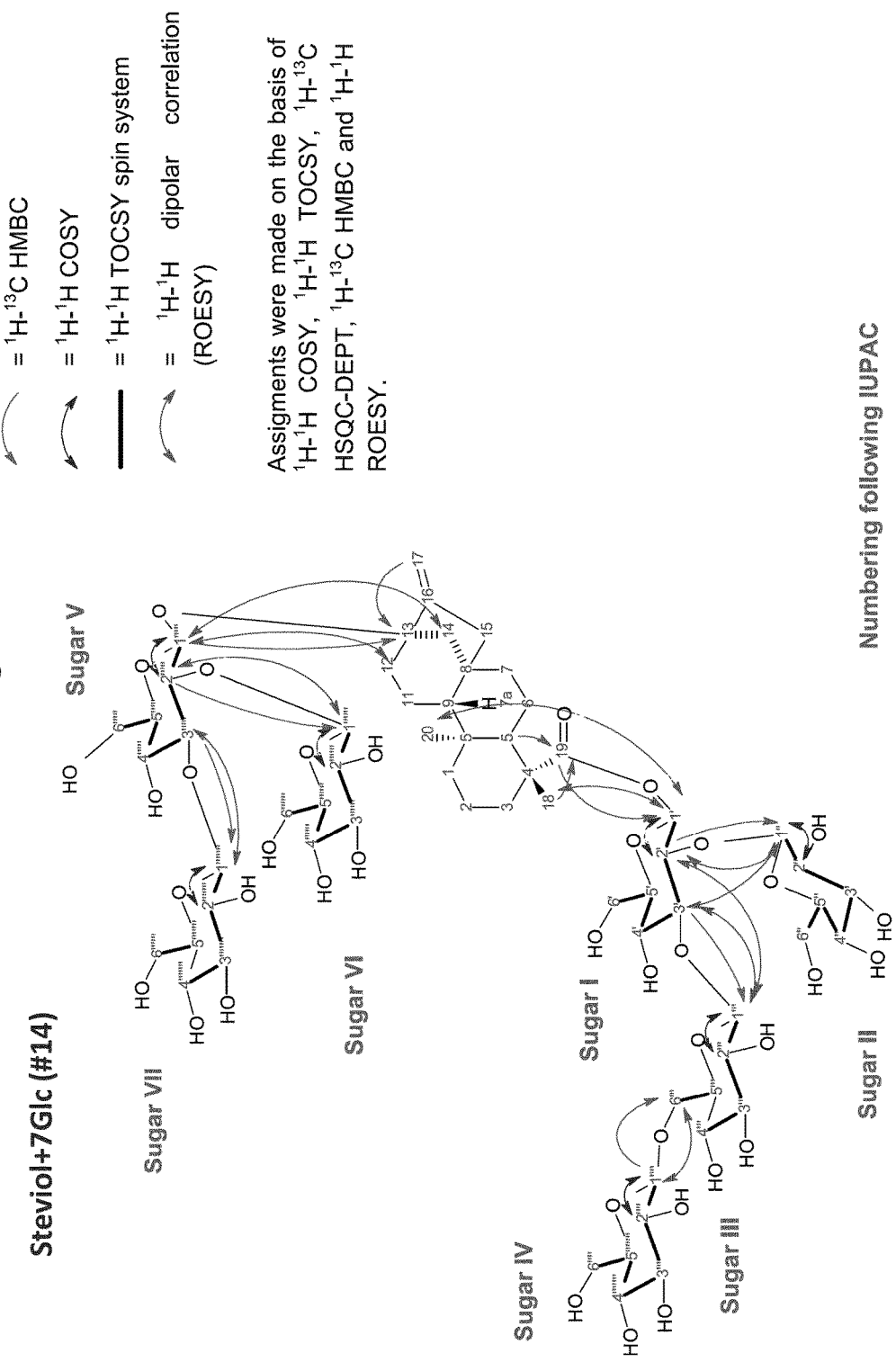

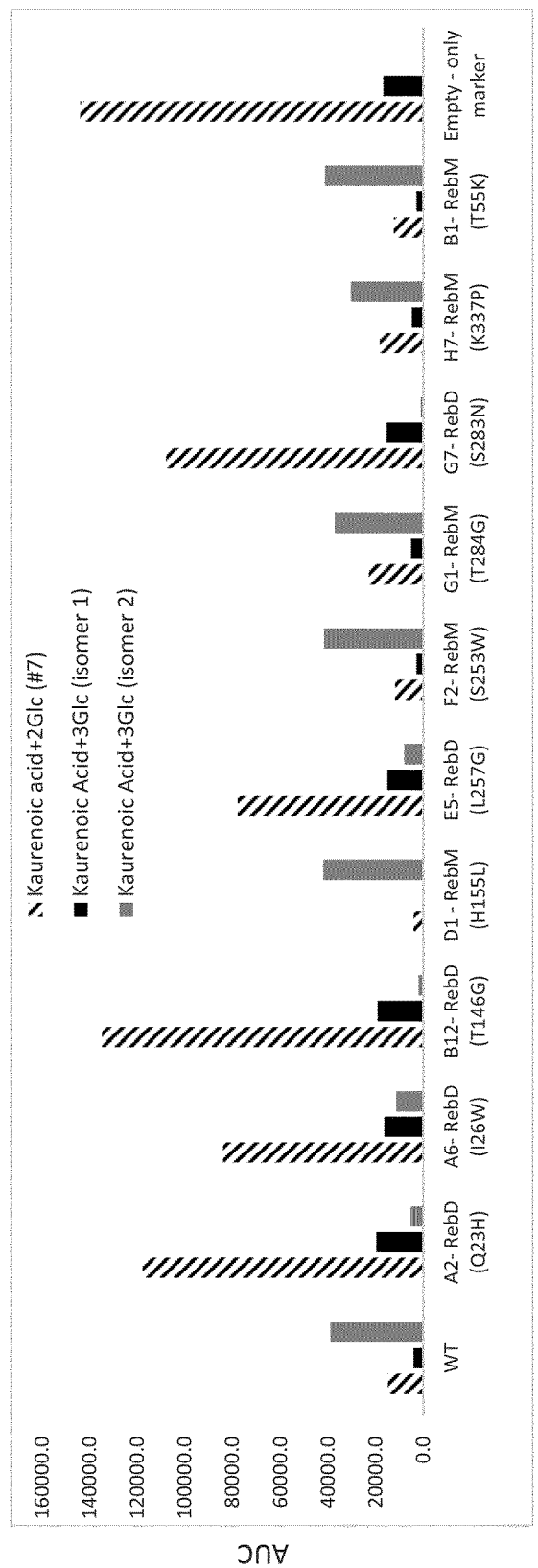

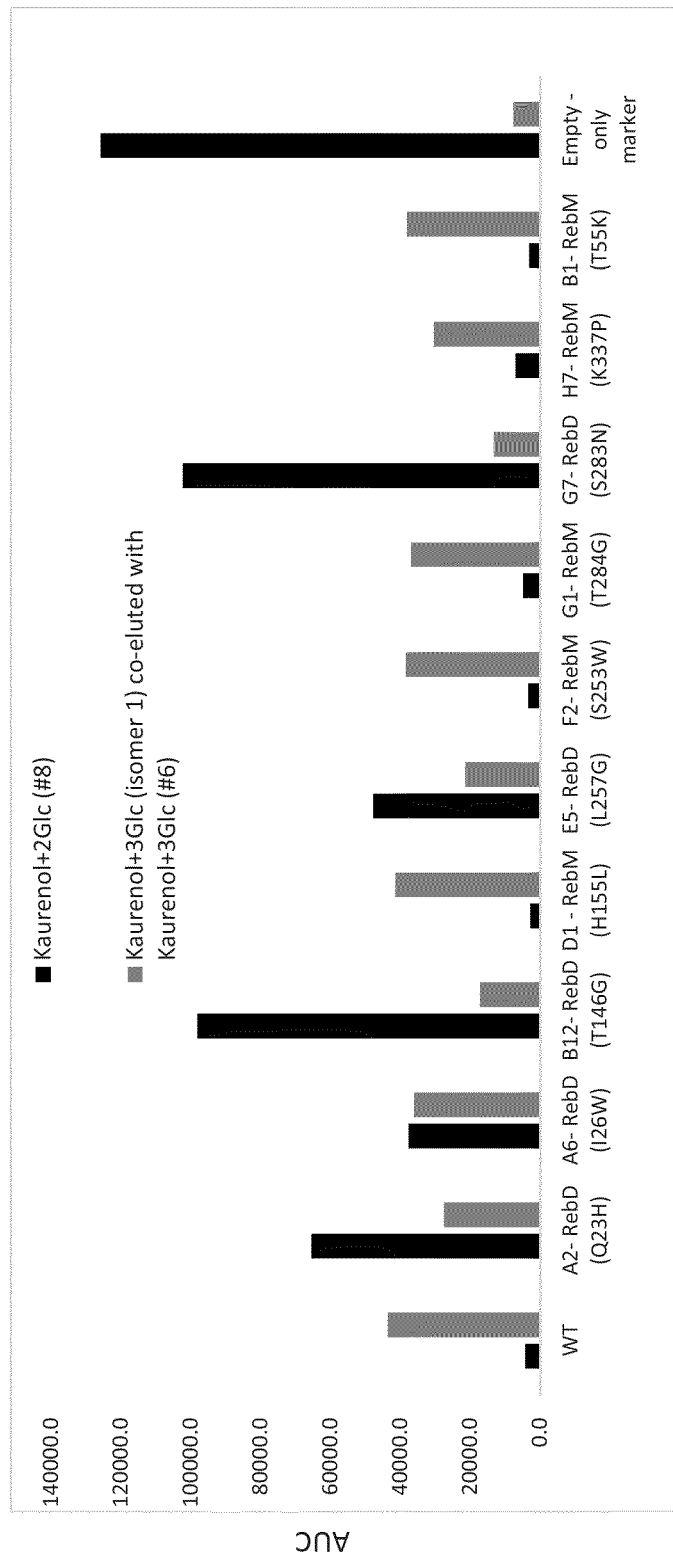

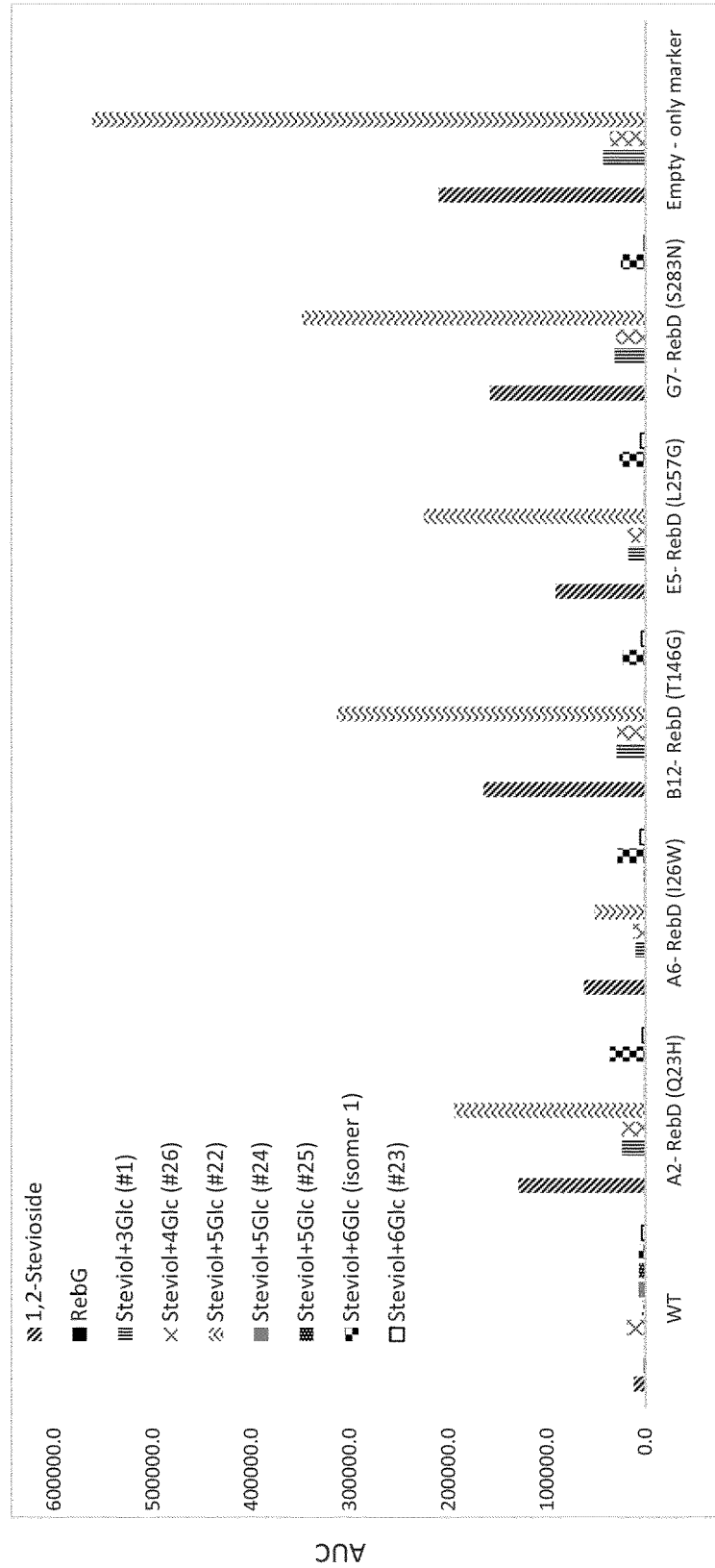

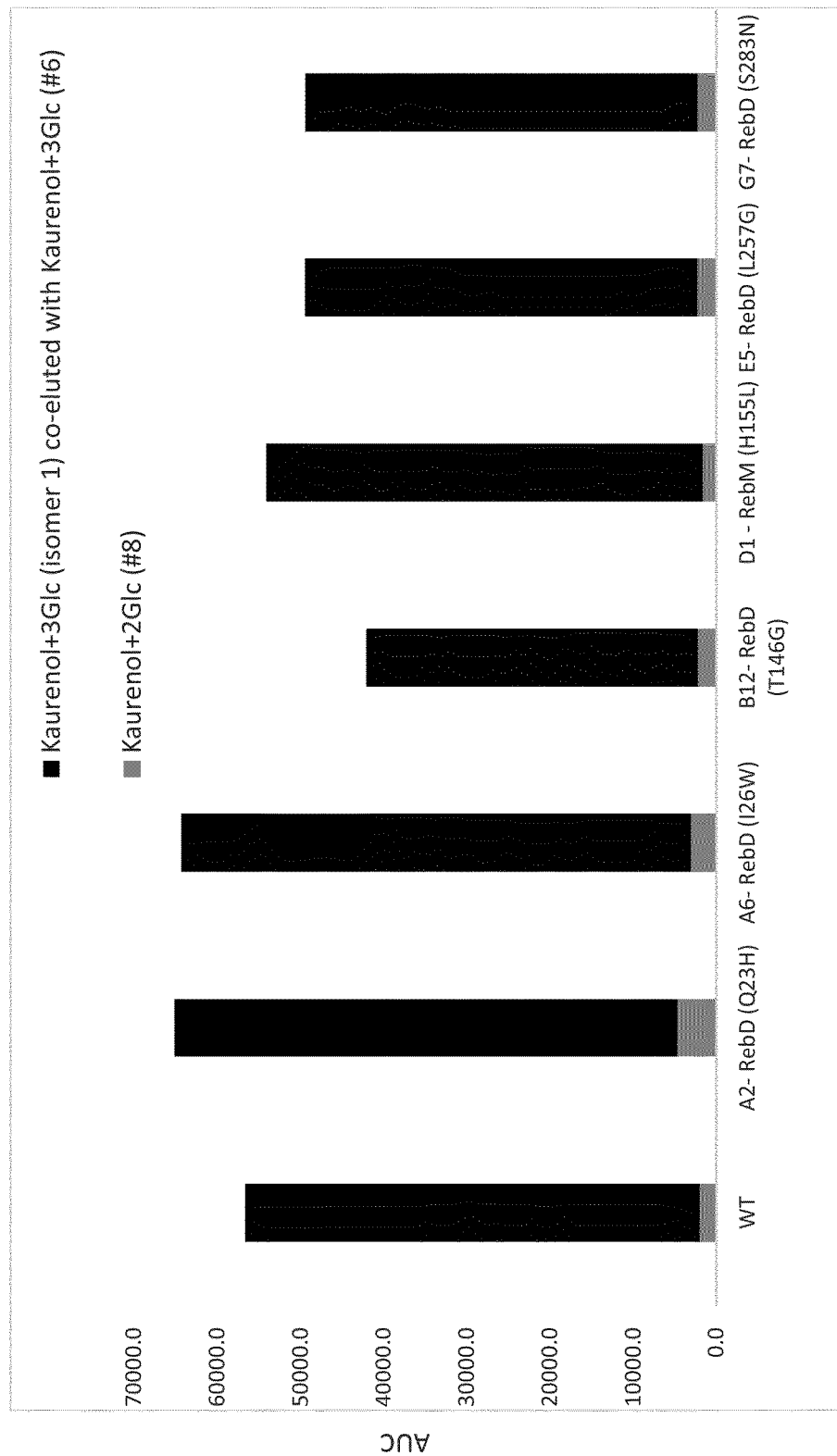

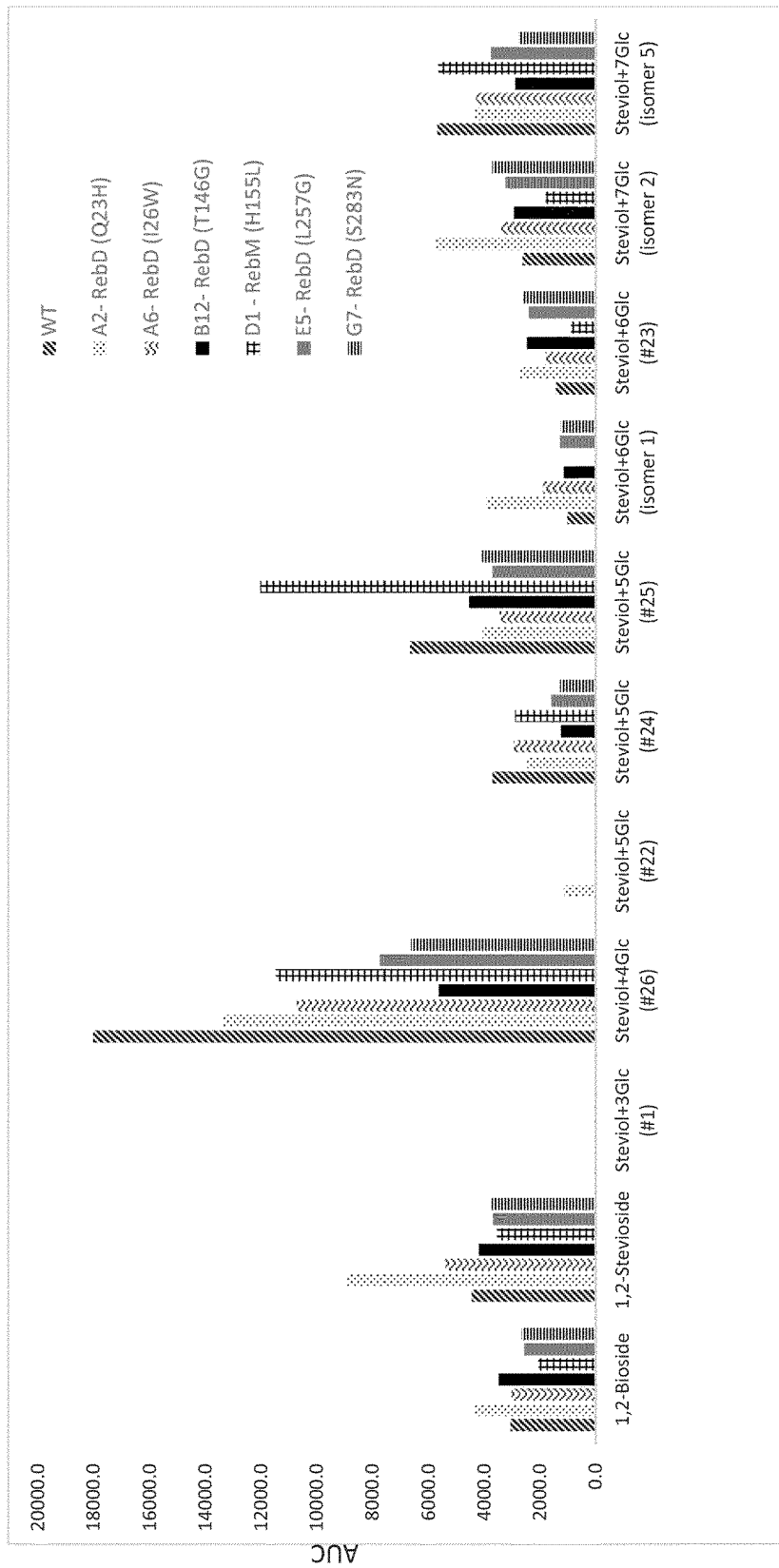

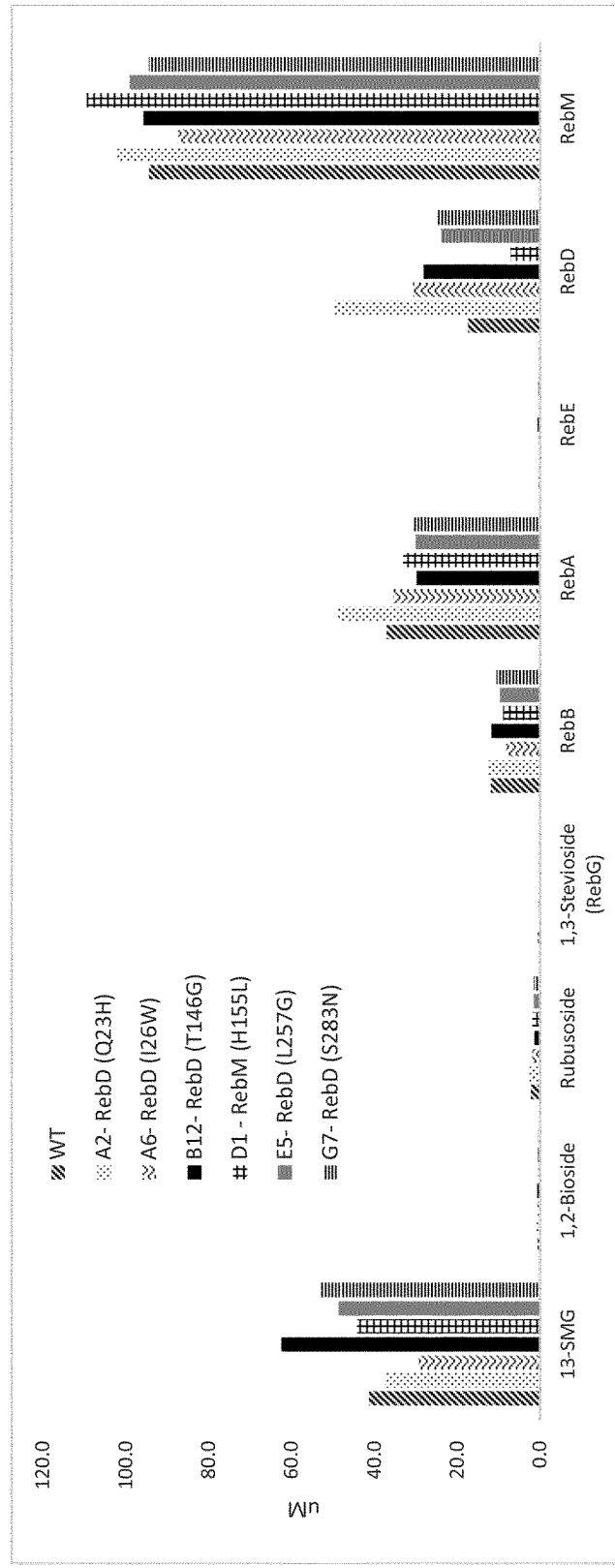

PRODUCTION OF STEVIOL GLYCOSIDE IN RECOMBINANT HOSTS

This application is a U.S. national phase of International Application No. PCT/EP2016/052007 filed Jan. 29, 2016, which claims the benefit of U.S. Provisional Application No. 62/110,207 filed on Jan. 30, 2015. The entire disclosure contents of these applications are herewith incorporated by reference in their entirety into the present application.

BACKGROUND OF THE INVENTION

Field of the Invention

This disclosure relates to recombinant production of steviol glycosides and steviol glycoside precursors in recombinant hosts. In particular, this disclosure relates to production of steviol glycosides comprising steviol-13-O-glucoside (13-SMG), steviol-19-O-glucoside (19-SMG), steviol-1,2-bioside, steviol-1,3-bioside, 1,2-stevioside, 1,3-stevioside, rubusoside (Rubu), rebaudioside A (RebA), rebaudioside B (RebB), rebaudioside D (RebD), rebaudioside E (RebE), rebaudioside M (RebM), rebaudioside Q (RebQ), rebaudioside I (RebI), di-glycosylated steviol, tri-glycosylated steviol, tetra-glycosylated steviol, penta-glycosylated steviol, hexa-glycosylated steviol, hepta-glycosylated steviol, glycosylated ent-kaurenol, glycosylated ent-kaurenoic acid, and/or isomers thereof in recombinant hosts.

Description of Related Art

Sweeteners are well known as ingredients used most commonly in the food, beverage, or confectionary industries. The sweetener can either be incorporated into a final food product during production or for stand-alone use, when appropriately diluted, as a tabletop sweetener or an at-home replacement for sugars in baking. Sweeteners include natural sweeteners such as sucrose, high fructose corn syrup, molasses, maple syrup, and honey and artificial sweeteners such as aspartame, saccharine, and sucralose. Stevia extract is a natural sweetener that can be isolated and extracted from a perennial shrub, *Stevia rebaudiana*. Stevia is commonly grown in South America and Asia for commercial production of *stevia* extract. Stevia extract, purified to various degrees, is used commercially as a high intensity sweetener in foods and in blends or alone as a tabletop sweetener.

Chemical structures for several steviol glycosides are shown in FIG. 1, including the diterpene steviol and various steviol glycosides. Extracts of the *Stevia* plant generally comprise steviol glycosides that contribute to the sweet flavor, although the amount of each steviol glycoside often varies, inter alia, among different production batches.

As recovery and purification of steviol glycosides from the *Stevia* plant have proven to be labor intensive and inefficient, there remains a need for a recombinant production system that can accumulate high yields of desired steviol glycosides, such as RebD and RebM. There also remains a need for improved production of steviol glycosides in recombinant hosts for commercial uses. As well, there remains a need for identifying enzymes selective towards particular substrates to produce one or more specific steviol glycosides. In some aspects, there remains a need to increase the catalytic capability of enzymes with 19-O glycosylation activity in order to produce higher yields of steviol glycosides.

SUMMARY OF THE INVENTION

It is against the above background that the present invention provides certain advantages and advancements over the prior art.

Although this invention as disclosed herein is not limited to specific advantages or functionalities, the invention provides a recombinant host cell, comprising at least one recombinant gene that is:

(a) a gene encoding a UGT91D2e polypeptide having at least 90% sequence identity to the amino acid sequence set forth in SEQ ID NO:11;

(b) a gene encoding a chimeric polypeptide having at least 70% sequence identity to the amino acid sequence set forth in SEQ ID NO:17 or SEQ ID NO:18;

(c) a gene encoding a UGT85C2 polypeptide having at least 55% sequence identity to the amino acid sequence set forth in SEQ ID NO:7; and/or (d) a gene encoding a UGT76G1 polypeptide having at least 50% sequence identity to the amino acid sequence set forth in SEQ ID NO:9;

wherein the recombinant host cell is capable of producing a steviol glycoside, glycosylated ent-kaurenol compound, and/or a glycosylated ent-kaurenoic acid compound in a cell culture broth.

In one aspect of the recombinant host cell disclosed herein, the UGT91D2e polypeptide comprises a UGT91D2e polypeptide having at least one amino acid substitution at residues 93, 99, 114, 144, 148, 152, 195, 196, 199, 211, 213, 221, 286, 384, 426, 438, or 466 of SEQ ID NO:11.

In one aspect of the recombinant host cell disclosed herein, the UGT85C2 polypeptide comprises a UGT85C2 polypeptide having at least one amino acid substitution at residues 21, 48, 49, 84, 86, 87, 91, 92, 95, 122, or 334 of SEQ ID NO:7.

In one aspect of the recombinant host cell disclosed herein, the UGT76G1 polypeptide comprises a UGT76G1 polypeptide having at least one amino acid substitution at residues 23, 26, 55, 146, 257, 283, and 337 of SEQ ID NO:9.

In one aspect of the recombinant host cell disclosed herein, the UGT91D2e polypeptide comprises one or more of the UGT91D2e polypeptide variants comprising: P93V, S991, S114F, T144K, T144L, T144M, A148K, M152T, L195G, L195C, L195S, L195N, L195V, V196P, K199C, L211H, L211M, L211I, L211C, L211T, L213E, S221I, V286C, V286N, V286S, G384W, G384K, G384Y, E426G, E438H, E438M or A466V of SEQ ID NO:11.

In one aspect of the recombinant host cell disclosed herein, the UGT85C2 polypeptide comprises one or more of the UGT85C2 polypeptide variants comprising: Q21L, Q21T, Q21V, F48S, F48H, F48Y, F48R, F48Q, F48W, F48T, I49V, S84G, S84A, S84T, S84C, S84P, S84N, S84V, P86R, P86G, 187H, 187P, 187M, 187Y, L91K, L91R, L91T, L92F, L92I, L92M, I95K, F122S, L334S or L334M of SEQ ID NO:7.

In one aspect of the recombinant host cell disclosed herein, the UGT76G1 polypeptide comprises one or more of the UGT76G1 polypeptide variants comprising: Q23H, I26W, T146G, H155L, L257G, S253W, T284G, S283N, K337P or T55K of SEQ ID NO:9.

In one aspect the recombinant host cell disclosed herein further comprises at least one recombinant gene that is:

(a) a gene encoding a geranylgeranyl diphosphate synthase (GGPPS) polypeptide;

(b) a gene encoding an ent-copalyl diphosphate synthase (CDPS) polypeptide;

(c) a gene encoding an ent-kaurene synthase (KS) polypeptide;
(d) a gene encoding an ent-kaurene oxidase (KO) polypeptide;
(e) a gene encoding a cytochrome P450 reductase (CPR) polypeptide; and
(f) a gene encoding an ent-kaurenoic acid hydroxylase (KAH) polypeptide;
(g) a gene encoding a UGT74G1 polypeptide; and/or
(h) a gene encoding an EUGT11 polypeptide;
wherein the recombinant host cell capable of producing a steviol glycoside, glycosylated ent-kaurenol compound, and/or a glycosylated ent-kaurenoic acid compound in a cell culture broth.

In one aspect of the recombinant host cell disclosed herein,
(a) the GGPPS polypeptide comprises a polypeptide having at least 70% identity to an amino acid sequence set forth in SEQ ID NO:20, SEQ ID NO:22, SEQ ID NO:24, SEQ ID NO:26, SEQ ID NO:28, SEQ ID NO:30, SEQ ID NO:32, or SEQ ID NO:116;
(b) the CDPS polypeptide comprises a polypeptide having at least 70% identity to an amino acid sequence set forth in SEQ ID NO:34, SEQ ID NO:36, SEQ ID NO:38, SEQ ID NO:40, or SEQ ID NO:42;
(c) the KS polypeptide comprises a polypeptide having at least 70% identity to an amino acid sequence set forth in SEQ ID NO:44, SEQ ID NO:46, SEQ ID NO:48, SEQ ID NO:50, or SEQ ID NO:52;
(d) the KO polypeptide comprises a polypeptide having at least 70% identity to an amino acid sequence set forth in SEQ ID NO:60, SEQ ID NO:62, SEQ ID NO:117, SEQ ID NO:66, SEQ ID NO:68, SEQ ID NO:70, SEQ ID NO:72, SEQ ID NO:74, or SEQ ID NO:76;
(e) the CPR polypeptide comprises a polypeptide having at least 70% identity to an amino acid sequence set forth in SEQ ID NO:78, SEQ ID NO:80, SEQ ID NO:82, SEQ ID NO:84, SEQ ID NO:86, SEQ ID NO:88, SEQ ID NO:90, SEQ ID NO:92;
(f) the KAH polypeptide comprises a polypeptide having at least 70% identity to an amino acid sequence set forth in SEQ ID NO:94, SEQ ID NO:97, SEQ ID NO:100, SEQ ID NO:101, SEQ ID NO:102, SEQ ID NO:103, SEQ ID NO:104, SEQ ID NO:106, SEQ ID NO:108, SEQ ID NO:110, SEQ ID NO:112, or SEQ ID NO:114;
(g) the UGT74G1 polypeptide comprises a polypeptide having at least 55% identity to an amino acid sequence set forth in SEQ ID NO:4;
(h) the EUGT11 polypeptide comprises a polypeptide having at least 65% identity to an amino acid sequence set forth in SEQ ID NO:16.

In one aspect of the recombinant host cell disclosed herein, the cell culture broth comprises:
(a) the steviol glycoside, glycosylated ent-kaurenol compound, and/or the glycosylated ent-kaurenoic acid compound produced by the recombinant host cell,
(b) glucose, fructose and/or sucrose; and/or
(c) supplemental nutrients comprising trace metals, vitamins, salts, yeast nitrogen base (YNB), and/or amino acids.

In one aspect of the recombinant host cell disclosed herein, the recombinant host comprises a plant cell, a mammalian cell, an insect cell, a fungal cell, an algal cell, or a bacterial cell.

In one aspect of the recombinant host cell disclosed herein, the bacterial cell comprises *Escherichia* cells, *Lactobacillus* cells, *Lactococcus* cells, *Cornebacterium* cells, *Acetobacter* cells, *Acinetobacter* cells, or *Pseudomonas* cells.

In one aspect of the recombinant host cell disclosed herein, the fungal cell comprises a yeast cell.

In one aspect of the recombinant host cell disclosed herein, the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous,* or *Candida albicans* species.

In one aspect of the recombinant host cell disclosed herein, the yeast cell is a Saccharomycete.

In one aspect of the recombinant host cell disclosed herein, the yeast cell is a cell from the *Saccharomyces cerevisiae* species.

The invention also provides a method of producing a steviol glycoside, glycosylated ent-kaurenol compound, and/or glycosylated ent-kaurenoic acid compound in a cell culture broth, comprising growing the recombinant host cell disclosed herein in a culture medium, under conditions in which one or more of the genes are expressed;
wherein at least one of the genes is a recombinant gene;
wherein the steviol glycoside, glycosylated ent-kaurenol compound, and/or the glycosylated ent-kaurenoic acid compound is produced by the recombinant host cell.

In one aspect of the methods disclosed herein, one or more of the genes is constitutively expressed and/or expression of one or more of the genes is induced.

The invention also provides a method for producing a steviol glycoside, glycosylated ent-kaurenol compound, and/or the glycosylated ent-kaurenoic acid compound comprising whole-cell bioconversion of plant-derived components or synthetic steviol or steviol glycosides using one or more of:
(a) a UGT91D2e polypeptide having at least 90% sequence identity to the amino acid sequence set forth in SEQ ID NO:11;
(b) a chimeric polypeptide having at least 70% sequence identity to the amino acid sequence set forth in SEQ ID NO:17 or SEQ ID NO:18;
(c) a UGT85C2 polypeptide having at least 55% sequence identity to the amino acid sequence set forth in SEQ ID NO:7; and/or
(d) a UGT76G1 polypeptide having at least 50% sequence identity to the amino acid sequence set forth in SEQ ID NO:9;
wherein at least one of the polypeptides is a recombinant polypeptide.

In one aspect of the methods disclosed herein, the whole cell is the recombinant host cell disclosed herein.

In one aspect of the methods disclosed herein, the recombinant host cell is grown in a fermentor at a temperature for a period of time, wherein the temperature and period of time facilitate the production of the steviol glycoside, glycosylated ent-kaurenol compound, and/or glycosylated ent-kaurenoic acid compound.

The invention also provides an in vitro method for producing a steviol glycoside, glycosylated ent-kaurenol compound, and/or the glycosylated ent-kaurenoic acid compound, comprising adding one or more of:
(a) a UGT91D2e polypeptide having at least 90% sequence identity to the amino acid sequence set forth in SEQ ID NO:11;

(b) a chimeric polypeptide having at least 70% sequence identity to the amino acid sequence set forth in SEQ ID NO:17 or SEQ ID NO:18;

(c) a UGT85C2 polypeptide having at least 55% sequence identity to the amino acid sequence set forth in SEQ ID NO:7; and/or (d) a UGT76G1 polypeptide having at least 50% sequence identity to the amino acid sequence set forth in SEQ ID NO:9, and plant-derived components or synthetic steviol or steviol glycosides to a reaction mixture;

wherein at least one of the polypeptides is a recombinant polypeptide; and (b) synthesizing steviol glycoside, glycosylated ent-kaurenol compound, and/or the glycosylated ent-kaurenoic acid compound in the reaction mixture.

In one aspect, methods disclosed herein further comprise isolating the steviol glycoside, glycosylated ent-kaurenol compound, and/or the glycosylated ent-kaurenoic acid compound, alone or in combination from the cell culture broth.

In one aspect of the methods disclosed herein, the isolating step comprises:

(a) providing the cell culture broth comprising the steviol glycoside, glycosylated ent-kaurenol compound, and/or the glycosylated ent-kaurenoic acid compound alone or in combination;

(b) separating a liquid phase of the cell culture broth from a solid phase of the cell culture broth to obtain a supernatant comprising the steviol glycoside, glycosylated ent-kaurenol compound, and/or the glycosylated ent-kaurenoic acid compound alone or in combination;

(c) providing one or more adsorbent resins, comprising providing the adsorbent resins in a packed column; and (d) contacting the supernatant of step (b) with the one or more adsorbent resins in order to obtain at least a portion of the steviol glycoside, glycosylated ent-kaurenol compound, and/or the glycosylated ent-kaurenoic acid compound alone or in combination thereby isolating the steviol glycoside, glycosylated ent-kaurenol compound, and/or the glycosylated ent-kaurenoic acid compound alone or in combination.

In one aspect, methods disclosed herein further comprise recovering the the steviol glycoside, glycosylated ent-kaurenol compound, and/or the glycosylated ent-kaurenoic acid compound alone or a composition comprising the steviol glycoside, glycosylated ent-kaurenol compound, and/or the glycosylated ent-kaurenoic acid compound.

In one aspect of the methods disclosed herein, the recovered composition is enriched for the steviol glycoside, glycosylated ent-kaurenol compound, and/or the glycosylated ent-kaurenoic acid compound relative to a steviol glycoside composition of *Stevia* plant and has a reduced level of non-steviol glycoside *Stevia* plant-derived components relative to a plant-derived *stevia* extract.

In one aspect of the methods disclosed herein, the cell culture broth comprises:

(a) one or more steviol glycosides, glycosylated ent-kaurenol compounds, and/or glycosylated ent-kaurenoic acid compounds produced by the recombinant host cell disclosed herein, (b) glucose, fructose, and/or sucrose; and/or (c) supplemental nutrients comprising trace metals, vitamins, salts, YNB, and/or amino acids.

In one aspect of the methods disclosed herein, the reaction mixture comprising:

(a) one or more steviol glycosides, glycosylated ent-kaurenol compounds, and/or a glycosylated ent-kaurenoic acid compounds produced in the reaction mixture;

(b) a UGT polypeptide;

(c) UDP-glucose, UDP-rhamnose, UDP-xylose, and/or N-acetyl-glucosamine; and/or (d) reaction buffer and/or salts.

In one aspect of the methods disclosed herein, the recombinant host cell comprises a plant cell, a mammalian cell, an insect cell, a fungal cell, an algal cell, or a bacterial cell.

In one aspect of the methods disclosed herein, the bacterial cell comprises *Escherichia* cells, *Lactobacillus* cells, *Lactococcus* cells, *Cornebacterium* cells, *Acetobacter* cells, *Acinetobacter* cells, or *Pseudomonas* cells.

In one aspect of the methods disclosed herein, the fungal cell comprises a yeast cell.

In one aspect of the methods disclosed herein, the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous,* or *Candida albicans* species.

In one aspect of the methods disclosed herein, the yeast cell is a Saccharomycete.

In one aspect of the methods disclosed herein, the yeast cell is a cell from the *Saccharomyces cerevisiae* species.

In one aspect of the recombinant hosts and methods disclosed herein, (a) the steviol glycoside comprises 13-SMG, 19-SMG, Steviol-1,2-bioside, Steviol-1,3-bioside, 1,2-stevioside, 1,3-stevioside, rubusoside, RebA, RebB, RebD, RebE, RebM, di-glycosylated tri-glycosylated steviol, tetra-glycosylated steviol, penta-glycosylated steviol, hexa-glycosylated steviol, hepta-glycosylated steviol, and/or isomers thereof;

(b) the glycosylated ent-kaurenol compound comprises di-glycosylated ent-kaurenol, tri-glycosylated ent-kaurenol, and/or isomers thereof; and/or (c) the glycosylated ent-kaurenoic acid compound comprises di-glycosylated ent-kaurenoic acid, tri-glycosylated ent-kaurenoic acid, and/or isomers thereof.

In one aspect of the recombinant hosts and methods disclosed herein, (a) the di-glycosylated steviol comprises compound 2.23 of Table 1;

(b) the tri-glycosylated steviol comprises compound 3.1 and/or compound 3.34 of Table 1;

(c) the tetra-glycosylated steviol comprises compound 4.26 and/or compound 4.33 of Table 1;

(d) the penta-glycosylated steviol comprises compound 5.22, compound 5.24, and/or compound 5.25 of Table 1;

(e) the hexa-glycosylated steviol comprises compound 6.1 and/or compound 6.23 of Table 1;

(f) the hepta-glycosylated steviol comprises compound 7.2, compound 7.5, and/or compound 7.13 of Table 1;

(g) the glycosylated ent-kaurenoic acid compound comprises compound KA3.1, compound KA3.2, and/or compound KA2.7 of Table 1; and/or (h) the glycosylated ent-kaurenol compound comprises compound KL2.8 and/or compound KL3.1 co-eluted with compound KL3.6 of Table 1.

In one aspect of the recombinant hosts and methods disclosed herein,
(a) compound 4.26 has the structure:
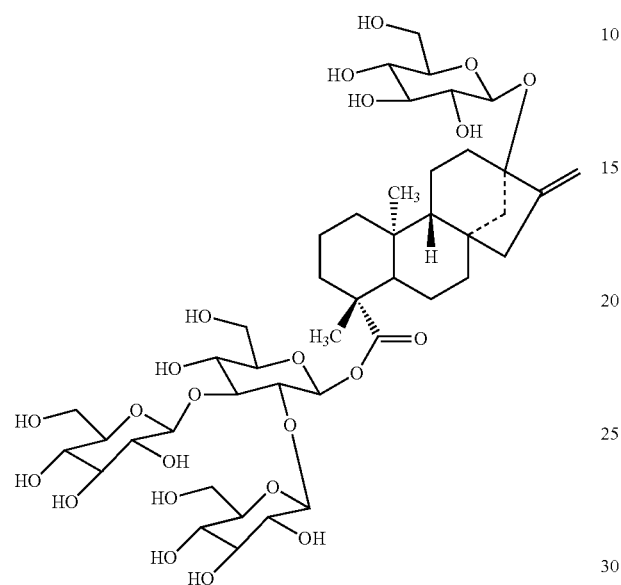
(b) compound 5.22 has the structure:
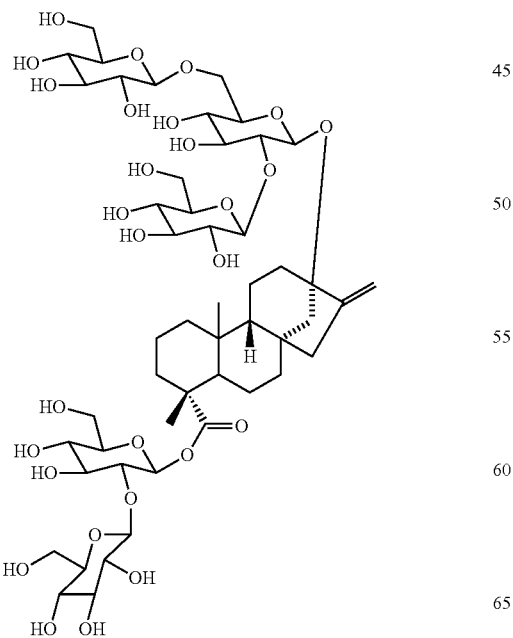
(c) compound 6.1 has the structure:
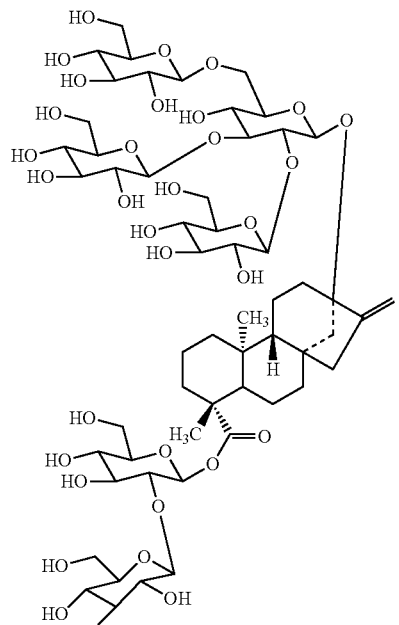
(d) compound 7.2 has the structure:
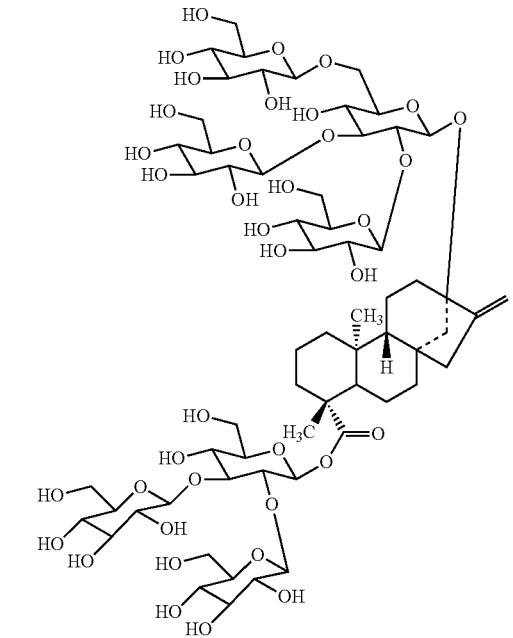

(e) compound 7.5 has the structure:
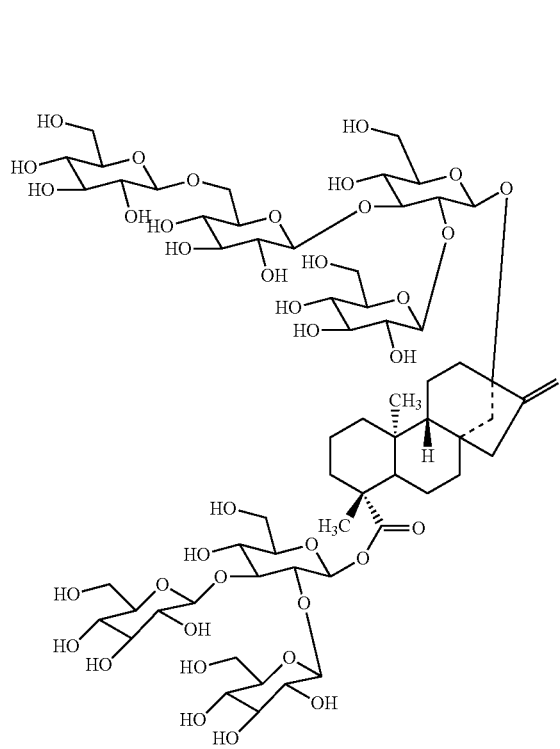
(f) compound KA3.1 has the structure:
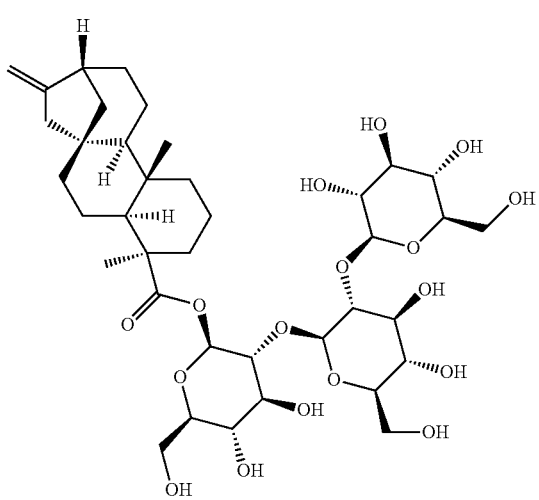
(g) compound KA3.2 has the structure:
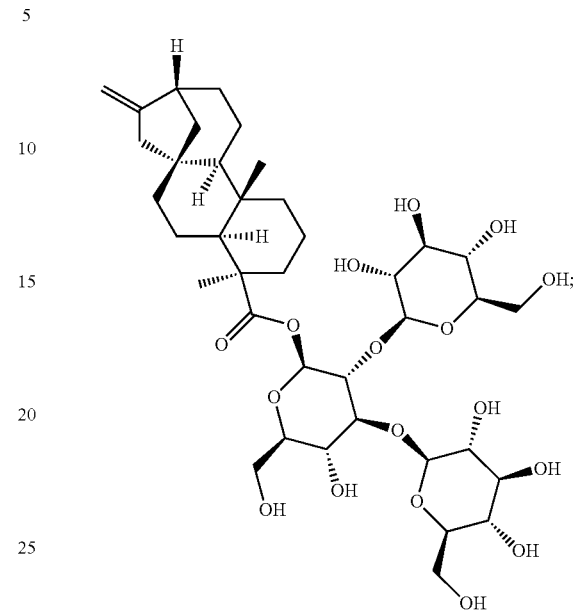
and
(h) compound KL3.1 has the structure:
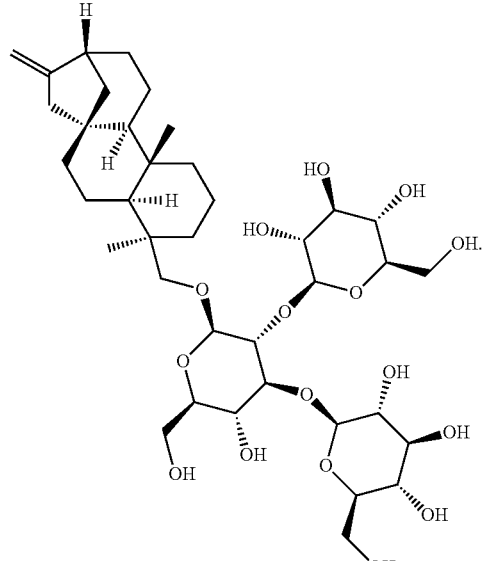
In one aspect of the recombinant hosts and methods disclosed herein, (a) the tri-glycosylated ent-kaurenoic acid comprises a compound having the structure:

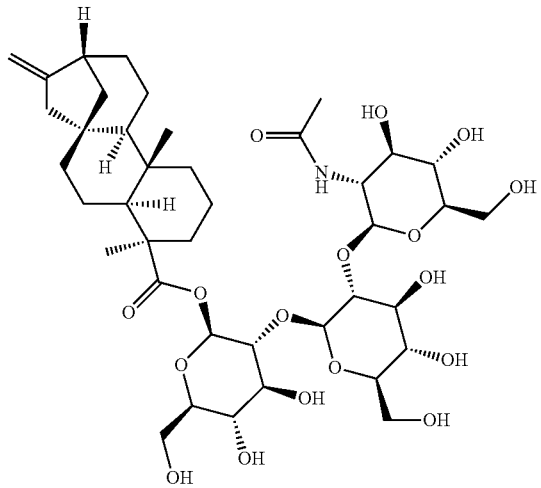

(b) the penta-glycosylated steviol comprises a compound having the structure:

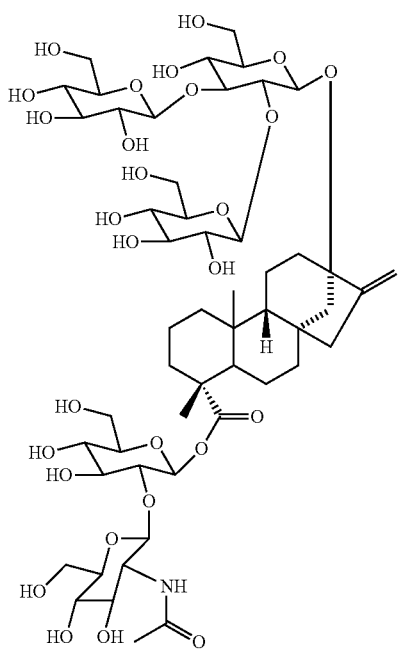

(c) the hexa-glycosylated steviol comprises a compound having the structure:

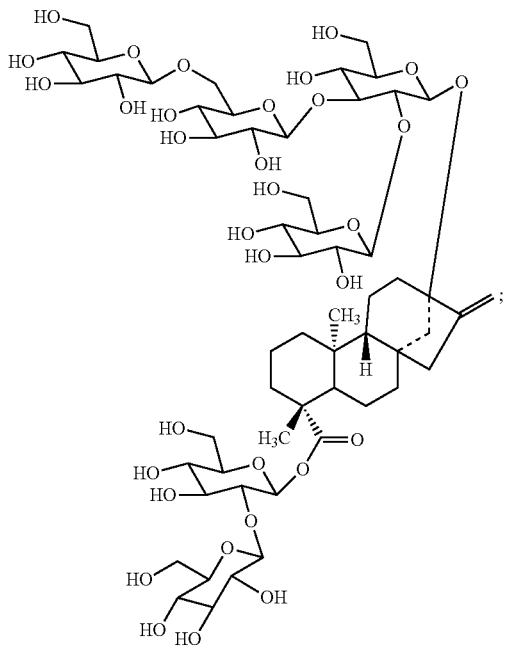

and (d) the hepta-glycosylated steviol comprises a compound having the structure:

The invention also provides a steviol glycoside composition produced by the recombinant host cell disclosed herein or the method disclosed herein, wherein the composition has a steviol glycoside composition enriched for RebD, RebM, or isomers thereof relative to a steviol glycoside composition of *Stevia* plant and has a reduced level of non-steviol glycoside *Stevia* plant-derived components relative to a plant-derived *stevia* extract.

The invention also provides a cell culture broth comprising:
(a) the recombinant host cell disclosed herein; and
(b) one or more steviol glycosides, glycosylated ent-kaurenol compounds, and/or glycosylated ent-kaurenoic acid compounds produced by the recombinant host cell;

wherein one or more steviol glycosides is present at a concentration of at least 1 mg/liter of the culture broth.

The invention also provides a cell culture broth comprising:
(a) one or more steviol glycosides, glycosylated ent-kaurenol compounds, and/or glycosylated ent-kaurenoic acid compounds produced by the recombinant host cell disclosed herein,
(b) glucose, fructose, sucrose, xylose, ethanol, and/or glycerol; and/or
(c) supplemental nutrients comprising trace metals, vitamins, salts, YNB, and/or amino acids.

The invention also provides a cell lysate comprising:
(a) one or more steviol glycosides, glycosylated ent-kaurenol compounds, and/or glycosylated ent-kaurenoic acid compounds produced by the recombinant host cell disclosed herein,
(b) glucose, fructose, sucrose, xylose, ethanol, glycerol, uridine diphosphate (UDP)-glucose, UDP-rhamnose, UDP-xylose, and/or N-acetyl-glucosamine; and/or
(c) supplemental nutrients comprising trace metals, vitamins, salts, YNB, and/or amino acids.

The invention also provides a reaction mixture comprising:
(a) one or more steviol glycosides, glycosylated ent-kaurenol compounds, and/or a glycosylated ent-kaurenoic acid compounds produced in the reaction mixture;
(b) a UGT polypeptide;
(c) glucose, fructose, sucrose, xylose, ethanol, glycerol, uridine diphosphate (UDP)-glucose, UDP-rhamnose, UDP-xylose, and/or N-acetyl-glucosamine; and/or
(d) reaction buffer and/or salts.

These and other features and advantages of the present invention will be more fully understood from the following detailed description taken together with the accompanying claims. It is noted that the scope of the claims is defined by the recitations therein and not by the specific discussion of features and advantages set forth in the present description.

BRIEF DESCRIPTION OF THE DRAWINGS

The following detailed description of the embodiments of the present invention can be best understood when read in conjunction with the following drawings, where like structure is indicated with like reference numerals and in which:

FIG. 4A shows accumulation of ent-kaurenoic acid+2Glc (#7), ent-kaurenoic acid+3Glc (isomer 1), and ent-kaurenoic acid+3Glc (isomer 2) by a steviol glycoside-producing S. cerevisiae strain deleted of UGT85C2 (SEQ ID NO:7).

FIG. 6B shows production of 1,2-bioside, rubusoside (Rubu), RebG, and RebE in a steviol glycoside-producing strain expressing UGT76G1 H155L (gray bars), compared to a control strain expressing wild-type UGT76G1 (black bars). FIG. 6C shows production of quantifiable steviol glycosides (13-SMG+1,2-bioside+Rubu+RebG+RebB+RebA+RebE+RebD+RebM) and RebD plus RebM titers in a steviol glycoside-producing strain expressing UGT76G1 H155L (gray bars), compared to a control strain expressing wild-type UGT76G1 (black bars). FIG. 6D shows production of a tri-glycosylated steviol molecule (steviol+3Glc (#1)), a tetra-glycosylated steviol molecule (steviol+4Glc (#26)), three penta-glycosylated steviol molecules (steviol+5Glc (#22), steviol+5Glc (#24), and steviol+5Glc (#25)), two hexa-glycosylated steviol molecules (steviol+6Glc (isomer 1) and steviol+6Glc (#23)), and two hepta-glycosylated steviol molecules (steviol+7Glc (isomer 2) and steviol+7Glc (#13)) in a steviol glycoside-producing strain expressing UGT76G1 H155L (gray bars), compared to a control strain expressing wild-type UGT76G1 (black bars). See Example 9.

FIG. 7A shows NMR-elucidated structures of tri-glycosylated ent-kaurenoic acid (Ent-Kaurenoic Acid+3Glc (isomers 1 and 2)), ent-kaurenoic acid+2Glc+1GlcNAc, and tri-glycosylated ent-kaurenol (ent-kaurenol+3Glc (isomer 1)). FIG. 7B shows NMR-elucidated structures of steviol+6Glc (isomer 1) and steviol+7Glc (isomer 2). FIG. 7C shows NMR-elucidated structures of steviol+6Glc (isomer 4) and steviol+7Glc (isomer 5). FIG. 7D shows NMR-elucidated structures of steviol+4Glc+1GlcNAc (#11) and steviol+4Glc (#26).

FIGS. 8A, 8B, and 8C show a $^1$H NMR spectrum and $^1$H and $^{13}$C NMR chemical shifts (in ppm) for ent-kaurenoic acid+3Glc (isomer 1). FIGS. 8D, 8E, and 8F show a $^1$H NMR spectrum and $^1$H and $^{13}$C NMR chemical shifts (in ppm) for ent-kaurenoic acid+3Glc (isomer 2). FIGS. 8G, 8H, and 8I show a $^1$H NMR spectrum and $^1$H and $^{13}$C NMR chemical shifts (in ppm) for ent-kaurenoic acid+2Glc+1GlcNAc. FIGS. 8J, 8K, and 8L show a $^1$H NMR spectrum and $^1$H and $^{13}$C NMR chemical shifts (in ppm) for ent-kaurenol+3Glc (isomer 1). FIGS. 8M, 8N, 8O, and 8P show a $^1$H NMR spectrum and $^1$H and $^{13}$C NMR chemical shifts (in ppm) for steviol+6Glc (isomer 1). FIGS. 8Q, 8R, 8S, and 8T show a $^1$H NMR spectrum and $^1$H and $^{13}$C NMR chemical shifts (in ppm) for steviol+7Glc (isomer 2). FIGS. 8U, 8V, 8W, and 8X show a $^1$H NMR spectrum and $^1$H and $^{13}$C NMR chemical shifts (in ppm) for steviol+6Glc (isomer 4). FIGS. 8Y, 8Z, 8AA, and 8AB show a $^1$H NMR spectrum and $^1$H and $^{13}$C NMR chemical shifts (in ppm) for steviol+7Glc (isomer 5). FIGS. 8AC, 8AD, 8AE, and 8AF show a $^1$H NMR spectrum and $^1$H and $^{13}$C NMR chemical shifts (in ppm) for steviol+4Glc+1GlcNAc (#11). FIGS. 8AG, 8AH, 8AI, and 8AJ show a $^1$H NMR spectrum and $^1$H and $^{13}$C NMR chemical shifts (in ppm) for steviol+4Glc (#26). FIGS. 8AK, 8AL, 8AM, and 8AN show a $^1$H NMR spectrum and $^1$H and $^{13}$C NMR chemical shifts (in ppm) for steviol+5Glc (#22). FIGS. 8AO, 8AP, 8AQ, and 8AR show a $^1$H NMR spectrum and $^1$H and $^{13}$C NMR chemical shifts (in ppm) for steviol+7Glc (#14). See Examples 6, 8, and 9.

FIG. 9A shows accumulation of ent-kaurenoic acid+2Glc (#7), ent-kaurenoic acid+3Glc (isomer 1), and ent-kaurenoic acid+3Glc (isomer 2) in S. cerevisiae expressing UGT76G1 variants. FIG. 9B shows accumulation of ent-kaurenol+2Glc (#8) and ent-kaurenol+3Glc (isomer 1) co-eluted with ent-kaurenol+3Glc (#6) in S. cerevisiae expressing UGT76G1 variants. See Example 8.

FIG. 10A shows accumulation of 1,2-stevioside, RebG, steviol+3Glc (#1), steviol+4Glc (#26), steviol+5Glc (#22), steviol+5Glc (#24), steviol+5Glc (#25), steviol+6Glc (isomer 1), and steviol+6Glc (#23) in S. cerevisiae expressing RebD-producing UGT76G1 variants.

FIG. 11C shows total levels of glycosylated ent-kaurenol (ent-kaurenol+3Glc (isomer 1) co-eluted with ent-kaurenol+3Glc (#6) and ent-kaurenol+2Glc (#8) in an S. cerevisiae steviol glycoside production strain expressing UGT76G1 variants. FIG. 11D shows accumulation of 1,2-bioside, 1,2-stevioside, steviol+3Glc (#1), steviol+4Glc (#26), steviol+5Glc (#22), steviol+5Glc (#24), steviol+5Glc (#25), steviol+6Glc (isomer 1), steviol+6Glc (#23), steviol+7Glc (isomer 2), and steviol+7Glc (isomer 5) in an S. cerevisiae steviol glycoside production strain expressing UGT76G1 variants. FIG. 11E shows accumulation of 13-SMG, 1,2-bioside, rubusoside, RebG, RebA, RebB, RebD, RebE, and RebM in an S. cerevisiae steviol glycoside production strain expressing UGT76G1 variants. See Example 8.

Figure 1:
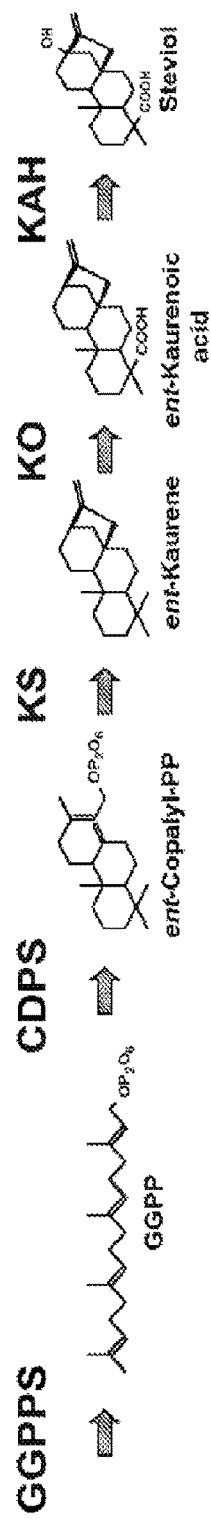
FIG. 1 shows a schematic of the engineered biosynthetic pathway for producing steviol in yeast from geranylgeranyl diphosphate using geranylgeranyl diphosphate synthase (GGPPS), ent-copalyl diphosphate synthase (CDPS), ent-kaurene synthase (KS), ent-kaurene oxidase (KO), and ent-kaurenoic acid hydroxylase (KAH) polypeptides.

Skilled artisans will appreciate that elements in the Figures are illustrated for simplicity and clarity and have not necessarily been drawn to scale. For example, the dimensions of some of the elements in the Figures can be exaggerated relative to other elements to help improve understanding of the embodiment(s) of the present invention.

DETAILED DESCRIPTION OF THE INVENTION

Before describing the present invention in detail, a number of terms will be defined. As used herein, the singular forms "a," "an," and "the" include plural referents unless the context clearly dictates otherwise. For example, reference to a "nucleic acid" means one or more nucleic acids.

It is noted that terms like "preferably," "commonly," and "typically" are not utilized herein to limit the scope of the claimed invention or to imply that certain features are critical, essential, or even important to the structure or function of the claimed invention. Rather, these terms are merely intended to highlight alternative or additional features that can or cannot be utilized in a particular embodiment of the present invention.

For the purposes of describing and defining the present invention it is noted that the term "substantially" is utilized herein to represent the inherent degree of uncertainty that can be attributed to any quantitative comparison, value, measurement, or other representation. The term "substantially" is also utilized herein to represent the degree by which a quantitative representation can vary from a stated reference without resulting in a change in the basic function of the subject matter at issue.

Methods well known to those skilled in the art can be used to construct genetic expression constructs and recombinant cells according to this invention. These methods include in vitro recombinant DNA techniques, synthetic techniques, in vivo recombination techniques, and polymerase chain reaction (PCR) techniques. See, for example, techniques as described in Green & Sambrook, 2012, MOLECULAR CLONING: A LABORATORY MANUAL, Fourth Edition, Cold Spring Harbor Laboratory, New York; Ausubel et al., 1989, CURRENT PROTOCOLS IN MOLECULAR BIOLOGY, Greene Publishing Associates and Wley Interscience, New York, and PCR Protocols: A Guide to Methods and Applications (Innis et al., 1990, Academic Press, San Diego, Calif.).

As used herein, the terms "polynucleotide," "nucleotide," "oligonucleotide," and "nucleic acid" can be used interchangeably to refer to nucleic acid comprising DNA, RNA, derivatives thereof, or combinations thereof, in either single-stranded or double-stranded embodiments depending on context as understood by the skilled worker.

As used herein, the terms "microorganism," "microorganism host," "microorganism host cell," "recombinant host," and "recombinant host cell" can be used interchangeably. As used herein, the term "recombinant host" is intended to refer to a host, the genome of which has been augmented by at least one DNA sequence. Such DNA sequences include but are not limited to genes that are not naturally present, DNA sequences that are not normally transcribed into RNA or translated into a protein ("expressed"), and other genes or DNA sequences which one desires to introduce into a host. It will be appreciated that typically the genome of a recombinant host described herein is augmented through stable introduction of one or more recombinant genes. Generally, introduced DNA is not originally resident in the host that is the recipient of the DNA, but it is within the scope of this disclosure to isolate a DNA segment from a given host, and to subsequently introduce one or more additional copies of that DNA into the same host, e.g., to enhance production of the product of a gene or alter the expression pattern of a gene. In some instances, the introduced DNA will modify or even replace an endogenous gene or DNA sequence by, e.g., homologous recombination or site-directed mutagenesis. Suitable recombinant hosts include microorganisms.

As used herein, the term "recombinant gene" refers to a gene or DNA sequence that is introduced into a recipient host, regardless of whether the same or a similar gene or DNA sequence may already be present in such a host. "Introduced," or "augmented" in this context, is known in the art to mean introduced or augmented by the hand of man. Thus, a recombinant gene can be a DNA sequence from another species or can be a DNA sequence that originated from or is present in the same species but has been incorporated into a host by recombinant methods to form a recombinant host. It will be appreciated that a recombinant gene that is introduced into a host can be identical to a DNA sequence that is normally present in the host being transformed, and is introduced to provide one or more additional copies of the DNA to thereby permit overexpression or modified expression of the gene product of that DNA. In some aspects, said recombinant genes are encoded by cDNA. In other embodiments, recombinant genes are synthetic and/or codon-optimized for expression in S. cerevisiae.

As used herein, the term "engineered biosynthetic pathway" refers to a biosynthetic pathway that occurs in a recombinant host, as described herein. In some aspects, one or more steps of the biosynthetic pathway do not naturally occur in an unmodified host. In some embodiments, a heterologous version of a gene is introduced into a host that comprises an endogenous version of the gene.

As used herein, the term "endogenous" gene refers to a gene that originates from and is produced or synthesized within a particular organism, tissue, or cell. In some embodiments, the endogenous gene is a yeast gene. In some embodiments, the gene is endogenous to S. cerevisiae, including, but not limited to S. cerevisiae strain S288C. In some embodiments, an endogenous yeast gene is overexpressed. As used herein, the term "overexpress" is used to refer to the expression of a gene in an organism at levels higher than the level of gene expression in a wild type organism. See, e.g., Prelich, 2012, Genetics 190:841-54. In some embodiments, an endogenous yeast gene, for example ADH, is deleted. See, e.g., Giaever & Nislow, 2014, Genetics 197(2):451-65. As used herein, the terms "deletion," "deleted," "knockout," and "knocked out" can be used interchangabley to refer to an endogenous gene that has been manipulated to no longer be expressed in an organism, including, but not limited to, S. cerevisiae.

As used herein, the terms "heterologous sequence" and "heterologous coding sequence" are used to describe a sequence derived from a species other than the recombinant host. In some embodiments, the recombinant host is an S. cerevisiae cell, and a heterologous sequence is derived from an organism other than S. cerevisiae. A heterologous coding sequence, for example, can be from a prokaryotic microorganism, a eukaryotic microorganism, a plant, an animal, an insect, or a fungus different than the recombinant host expressing the heterologous sequence. In some embodiments, a coding sequence is a sequence that is native to the host.

A "selectable marker" can be one of any number of genes that complement host cell auxotrophy, provide antibiotic resistance, or result in a color change. Linearized DNA fragments of the gene replacement vector then are introduced into the cells using methods well known in the art (see below). Integration of the linear fragments into the genome and the disruption of the gene can be determined based on the selection marker and can be verified by, for example, PCR or Southern blot analysis. Subsequent to its use in selection, a selectable marker can be removed from the genome of the host cell by, e.g., Cre-LoxP systems (see, e.g., Gossen et al., 2002, Ann. Rev. Genetics 36:153-173 and U.S. 2006/0014264). Alternatively, a gene replacement vector can be constructed in such a way as to include a portion of the gene to be disrupted, where the portion is devoid of any endogenous gene promoter sequence and encodes none, or an inactive fragment of, the coding sequence of the gene.

As used herein, the terms "variant" and "mutant" are used to describe a protein sequence that has been modified at one or more amino acids, compared to the wild-type sequence of a particular protein.

As used herein, the term "inactive fragment" is a fragment of the gene that encodes a protein having, e.g., less than about 10% (e.g., less than about 9%, less than about 8%, less than about 7%, less than about 6%, less than about 5%, less than about 4%, less than about 3%, less than about 2%, less than about 1%, or 0%) of the activity of the protein produced from the full-length coding sequence of the gene. Such a portion of a gene is inserted in a vector in such a way that no known promoter sequence is operably linked to the gene sequence, but that a stop codon and a transcription termination sequence are operably linked to the portion of the gene sequence. This vector can be subsequently linearized in the portion of the gene sequence and transformed into a cell. By way of single homologous recombination, this linearized vector is then integrated in the endogenous counterpart of the gene with inactivation thereof.

Figure 2:
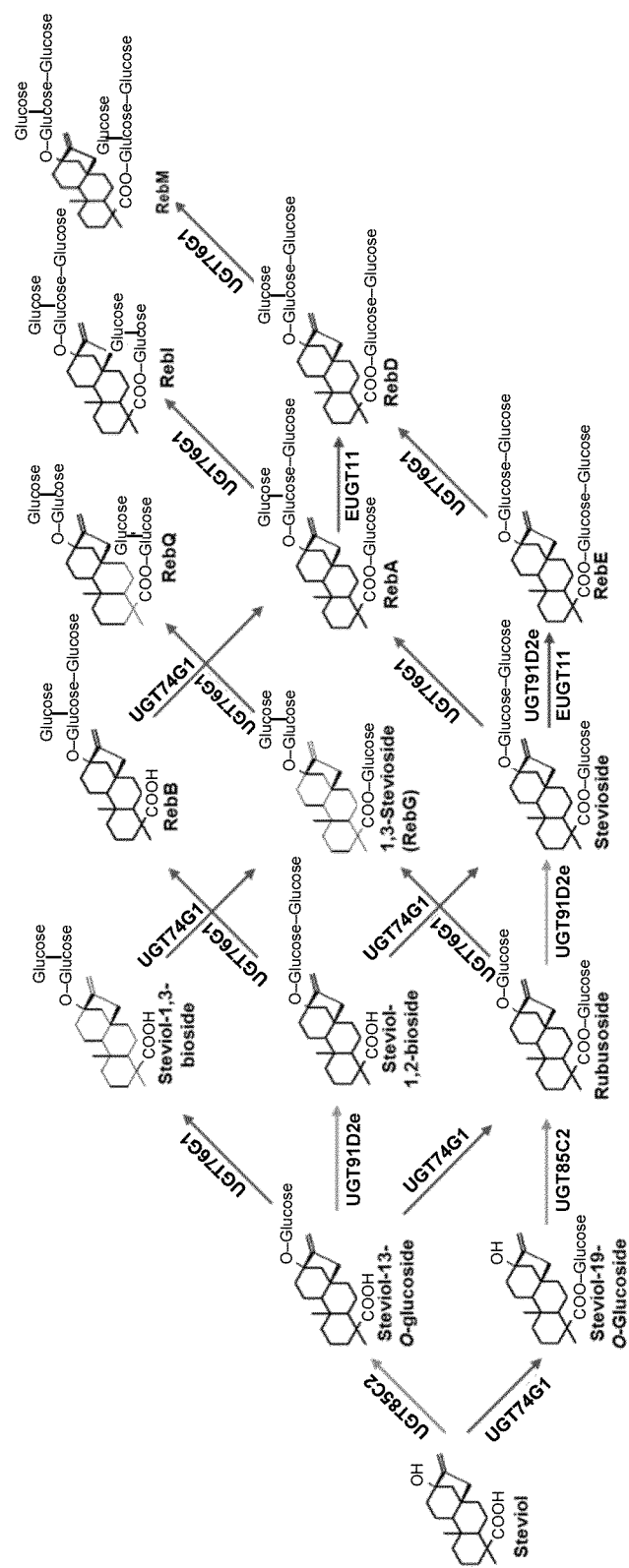
FIG. 2 shows representative steviol glycoside glycosylation reactions catalyzed by suitable uridine 5'-diphospho (UDP) glycosyl transferases (UGT) enzymes and chemical structures for several steviol glycoside compounds.

As used herein, the term "steviol glycoside" refers to rebaudioside A (RebA) (CAS #58543-16-1), rebaudioside B (RebB) (CAS #58543-17-2), rebaudioside C (RebC) (CAS #63550-99-2), rebaudioside D (RebD) (CAS #63279-13-0), rebaudioside E (RebE) (CAS #63279-14-1), rebaudioside F (RebF) (CAS #438045-89-7), rebaudioside M (RebM) (CAS #1220616-44-3), rubusoside (CAS #63849-39-4), dulcoside A (CAS #64432-06-0), rebaudioside I (RebI) (MassBank Record: FU000332), rebaudioside Q (RebQ), 1,2-stevioside (CAS #57817-89-7), 1,3-stevioside (RebG), 1,2-bioside (MassBank Record: FU000299), 1,3-bioside, steviol-13-O-glucoside (13-SMG), steviol-19-O-glucoside (19-SMG), a di-glycosylated steviol, a tri-glycosylated steviol, a tetra-glycosylated steviol, a penta-glycosylated steviol, a hexa-glycosylated steviol, a hepta-glycosylated steviol, and/or isomers thereof. See FIG. 2; see also, Steviol Glycosides Chemical and Technical Assessment 69th JECFA, 2007, prepared by Harriet Wallin, Food Agric. Org. See FIG. 2, FIG. 7, FIG. 8, and Table 1; see also, Steviol Glycosides Chemical and Technical Assessment 69th JECFA, 2007, prepared by Harriet Wallin, Food Agric. Org. Glycosylated steviol compounds can comprise one or more glucose, N-acetylglucosamine (GlcNAc), rhamnose, and/or xylose moieties. Non-limiting examples of steviol glycosides that can be produced by methods described herein are shown in Table 1, FIG. 7, and FIG. 8.

As used herein, the term "glycosylated ent-kaurenol compound" refers to di-glycosylated ent-kaurenol or tri-glycosylated ent-kaurenol. As used herein, the term "glycosylated ent-kaurenoic acid compound" refers to di-glycosylated ent-kaurenoic acid or tri-glycosylated ent-kaurenoic acid. See FIG. 7, FIG. 8, and Table 1. Glycosylated ent-kaurenol compounds and glycosylated ent-kaurenoic acid compounds can comprise one or more glucose, GlcNAc, rhamnose, and/or xylose moieties. Non-limiting examples of glycosylated ent-kaurenol compounds and glycosylated ent-kaurenoic acid compounds that can be produced by methods described herein are shown in Table 1, FIG. 7, and FIG. 8.

As used herein, the terms "steviol glycoside precursor" and "steviol glycoside precursor compound" are used to refer to intermediate compounds in the steviol glycoside biosynthetic pathway. Steviol glycoside precursors include, but are not limited to, geranylgeranyl diphosphate (GGPP), ent-copalyl-diphosphate, ent-kaurene, ent-kaurenol, ent-kaurenal, ent-kaurenoic acid, and steviol. See FIG. 1. In some embodiments, steviol glycoside precursors are themselves steviol glycoside compounds. For example, 19-SMG, rubusoside, stevioside, and RebE are steviol glycoside precursors of RebM. See FIG. 2. Steviol glycosides and/or steviol glycoside precursors can be produced in vivo (i.e., in a recombinant host), in vitro (i.e., enzymatically), or by whole cell bioconversion. As used herein, the terms "produce" and "accumulate" can be used interchangeably to describe synthesis of steviol glycosides and steviol glycoside precursors in vivo, in vitro, or by whole cell bioconversion.

As used herein, the term "cell culture broth" can be used to refer to a liquid that can support or has supported growth of a host cell, including, but not limited to, a yeast host cell. The components of a cell culture broth can include, for example, a steviol glycoside, a glycosylated ent-kaurenol compound, and/or a glycosylated ent-kaurenoic acid compound produced by the host cell, glucose, fructose, sucrose, trace metals, vitamins, salts, yeast nitrogen base (YNB), and/or amino acids.

As used herein, the term "cell lysate" can be used to refer to a fluid comprising the components of a lysed cell, i.e., a cell whose membrane has been disrupted chemically or mechanically. A cell lysate can further comprise a steviol glycoside, a glycosylated ent-kaurenol compound, and/or a glycosylated ent-kaurenoic acid compound produced by the host cell, glucose, fructose, sucrose, xylose, rhamnose, uridine diphosphate (UDP)-glucose, UDP-rhamnose, UDP-xylose, GlcNAc, trace metals, vitamins, salts, YNB, and/or amino acids. In some aspects, a cell lysate is a yeast cell lysate, such as an *S. cerevisiae* cell lysate, or a bacterial cell lysate, such as an *E. coli* cell lysate.

As used herein, the term "reaction mixture" refers to a solution for conducting an in vitro reaction. The components of a reaction mixture can include, but are not limited to, a steviol glycoside, a glycosylated ent-kaurenol compound, a glycosylated ent-kaurenoic acid compound, a polypeptide such as a UGT polypeptide, UDP-glucose, UDP-rhamnose, UDP-xylose, GlcNAC, a buffer, and/or salts.

Recombinant steviol glycoside-producing *Saccharomyces cerevisiae* (*S. cerevisiae*) strains are described in WO 2011/153378, WO 2013/022989, WO 2014/122227, and WO 2014/122328. Methods of producing steviol glycosides in recombinant hosts, by whole cell bio-conversion, and in vitro are also described in WO 2011/153378, WO 2013/022989, WO 2014/122227, and WO 2014/122328.

In some embodiments, steviol glycosides and/or steviol glycoside precursors are produced in vivo through expression of one or more enzymes involved in the steviol glycoside biosynthetic pathway in a recombinant host. For example, a steviol-producing recombinant host expressing one or more of a gene encoding a GGPPS polypeptide, a gene encoding a CDPS polypeptide, a gene encoding a KS polypeptide, a gene encoding a KO polypeptide, a gene encoding a KAH polypeptide, a gene encoding a CPR polypeptide, and a gene encoding a UGT polypeptide can produce a steviol glycoside and/or steviol glycoside precursors in vivo. See, e.g., FIGS. 1 and 2. The skilled worker will appreciate that one or more of these genes can be endogenous to the host provided that at least one (and in some embodiments, all) of these genes is a recombinant gene introduced into the recombinant host.

A recombinant host described herein can comprise a gene encoding a polypeptide capable of synthesizing geranylgeranyl pyrophosphate (GGPP) from farnesyl diphosphate (FPP) and isopentenyl diphosphate (IPP), a gene encoding a polypeptide capable of synthesizing ent-copalyl dirophosphate from GGPP; a gene encoding a polypeptide capable of synthesizing ent-kaurene from ent-copalyl pyrophosphate, a gene encoding a polypeptide capable of synthesizing ent-kaurenoic acid from ent-kaurene, a gene encoding a polypeptide capable of synthesizing steviol from ent-kaurenoic acid; and/or a gene encoding a polypeptide capable of converting NADPH to NADP+. A GGPPS polypeptide can synthesize GGPP from FPP and IPP. A CDPS polypeptide can synthesize ent-copalyl dirophosphate from GGPP. A KS polypeptide can synthesize ent-kaurene from ent-copalyl pyrophosphate. A KO polypeptide can synthesize ent-kaurenoic acid from ent-kaurene. A KAH polypeptide can synthesize steviol from ent-kaurenoic acid. A CPR polypeptide can convert NADPH to NADP+.

In another example, a recombinant host expressing a gene encoding a GGPPS polypeptide, a gene encoding a CDPS polypeptide, a gene encoding a KS polypeptide, a gene encoding a KO polypeptide, a gene encoding a KAH polypeptide, and a gene encoding a CPR polypeptide can produce steviol in vivo. See, e.g., FIG. 1. The skilled worker will appreciate that one or more of these genes can be endogenous to the host provided that at least one (and in some embodiments, all) of these genes is a recombinant gene introduced into the recombinant host.

In another example, a recombinant host expressing a gene encoding a GGPPS polypeptide, a gene encoding a CDPS polypeptide, a gene encoding a KS polypeptide, a gene encoding a KO polypeptide, a gene encoding a KAH polypeptide, a gene encoding a CPR polypeptide, and one or more of a gene encoding a UGT polypeptide can produce a steviol glycoside in vivo. See, e.g., FIGS. 1 and 2. The skilled worker will appreciate that one or more of these genes can be endogenous to the host provided that at least one (and in some embodiments, all) of these genes is a recombinant gene introduced into the recombinant host.

In some aspects, the GGPPS polypeptide comprises a polypeptide having an amino acid sequence set forth in SEQ ID NO:20 (which can be encoded by the nucleotide sequence set forth in SEQ ID NO:19), SEQ ID NO:22 (which can be encoded by the nucleotide sequence set forth in SEQ ID NO:21), SEQ ID NO:24 (which can be encoded by the nucleotide sequence set forth in SEQ ID NO:23), SEQ ID NO:26 (which can be encoded by the nucleotide sequence set forth in SEQ ID NO:25), SEQ ID NO:28 (which can be encoded by the nucleotide sequence set forth in SEQ ID NO:27), SEQ ID NO:30 (which can be encoded by the nucleotide sequence set forth in SEQ ID NO:29), SEQ ID NO:32 (which can be encoded by the nucleotide sequence set forth in SEQ ID NO:31), or SEQ ID NO:116 (which can be encoded by the nucleotide sequence set forth in SEQ ID NO:115).

In some aspects, the CDPS polypeptide comprises a polypeptide having an amino acid sequence set forth in SEQ ID NO:34 (which can be encoded by the nucleotide sequence set forth in SEQ ID NO:33), SEQ ID NO:36 (which can be encoded by the nucleotide sequence set forth in SEQ ID NO:35), SEQ ID NO:38 (which can be encoded by the nucleotide sequence set forth in SEQ ID NO:37), SEQ ID NO:40 (which can be encoded by the nucleotide sequence set forth in SEQ ID NO:39), or SEQ ID NO:42

(which can be encoded by the nucleotide sequence set forth in SEQ ID NO:41). In some embodiments, the CDPS polypeptide lacks a chloroplast transit peptide.

In some aspects, the KS polypeptide comprises a polypeptide having an amino acid sequence set forth in SEQ ID NO:44 (which can be encoded by the nucleotide sequence set forth in SEQ ID NO:43), SEQ ID NO:46 (which can be encoded by the nucleotide sequence set forth in SEQ ID NO:45), SEQ ID NO:48 (which can be encoded by the nucleotide sequence set forth in SEQ ID NO:47), SEQ ID NO:50 (which can be encoded by the nucleotide sequence set forth in SEQ ID NO:49), or SEQ ID NO:52 (which can be encoded by the nucleotide sequence set forth in SEQ ID NO:51).

In some embodiments, a recombinant host comprises a gene encoding a CDPS-KS polypeptide. In some aspects, the CDPS-KS polypeptide comprises a polypeptide having an amino acid sequence set forth in SEQ ID NO:54 (which can be encoded by the nucleotide sequence set forth in SEQ ID NO:53), SEQ ID NO:56 (which can be encoded by the nucleotide sequence set forth in SEQ ID NO:55), or SEQ ID NO:58 (which can be encoded by the nucleotide sequence set forth in SEQ ID NO:57).

In some aspects, the KO polypeptide comprises a polypeptide having an amino acid sequence set forth in SEQ ID NO:60 (which can be encoded by the nucleotide sequence set forth in SEQ ID NO:59), SEQ ID NO:62 (which can be encoded by the nucleotide sequence set forth in SEQ ID NO:61), SEQ ID NO:117 (which can be encoded by the nucleotide sequence set forth in SEQ ID NO:63 or SEQ ID NO:64), SEQ ID NO:66 (which can be encoded by the nucleotide sequence set forth in SEQ ID NO:65), SEQ ID NO:68 (which can be encoded by the nucleotide sequence set forth in SEQ ID NO:67), SEQ ID NO:70 (which can be encoded by the nucleotide sequence set forth in SEQ ID NO:69), SEQ ID NO:72 (which can be encoded by the nucleotide sequence set forth in SEQ ID NO:71), SEQ ID NO:74 (which can be encoded by the nucleotide sequence set forth in SEQ ID NO:73), or SEQ ID NO:76 (which can be encoded by the nucleotide sequence set forth in SEQ ID NO:75).

In some aspects, the CPR polypeptide comprises a polypeptide having an amino acid sequence set forth in SEQ ID NO:78 (which can be encoded by the nucleotide sequence set forth in SEQ ID NO:77), SEQ ID NO:80 (which can be encoded by the nucleotide sequence set forth in SEQ ID NO:79), SEQ ID NO:82 (which can be encoded by the nucleotide sequence set forth in SEQ ID NO:81), SEQ ID NO:84 (which can be encoded by the nucleotide sequence set forth in SEQ ID NO:83), SEQ ID NO:86 (which can be encoded by the nucleotide sequence set forth in SEQ ID NO:85), SEQ ID NO:88 (which can be encoded by the nucleotide sequence set forth in SEQ ID NO:87), SEQ ID NO:90 (which can be encoded by the nucleotide sequence set forth in SEQ ID NO:89), or SEQ ID NO:92 (which can be encoded by the nucleotide sequence set forth in SEQ ID NO:91).

In some aspects, the KAH polypeptide comprises a polypeptide having an amino acid sequence set forth in SEQ ID NO:94 (which can be encoded by the nucleotide sequence set forth in SEQ ID NO:93), SEQ ID NO:97 (which can be encoded by the nucleotide sequence set forth in SEQ ID NO:95 or SEQ ID NO:96), SEQ ID NO:100 (which can be encoded by the nucleotide sequence set forth in SEQ ID NO:98 or SEQ ID NO:99), SEQ ID NO:101, SEQ ID NO:102, SEQ ID NO:103, SEQ ID NO:104, SEQ ID NO:106 (which can be encoded by the nucleotide sequence set forth in SEQ ID NO:105), SEQ ID NO:108 (which can be encoded by the nucleotide sequence set forth in SEQ ID NO:107), SEQ ID NO:110 (which can be encoded by the nucleotide sequence set forth in SEQ ID NO:109), SEQ ID NO:112 (which can be encoded by the nucleotide sequence set forth in SEQ ID NO:111), or SEQ ID NO:114 (which can be encoded by the nucleotide sequence set forth in SEQ ID NO:113).

In some embodiments, a recombinant host comprises a nucleic acid encoding a UGT85C2 polypeptide (SEQ ID NO:7), a nucleic acid encoding a UGT76G1 polypeptide (SEQ ID NO:9), a nucleic acid encoding a UGT74G1 polypeptide (SEQ ID NO:4), a nucleic acid encoding a UGT91D2 polypeptide, and/or a nucleic acid encoding a EUGT11 polypeptide (SEQ ID NO:16). In some aspects, the UGT91D2 polypeptide can be a UGT91D2e polypeptide (SEQ ID NO:11) or a UGT91D2e-b polypeptide (SEQ ID NO:13). In some aspects, the UGT85C2 polypeptide can be encoded by the nucleotide sequence set forth in SEQ ID NO:5 or SEQ ID NO:6, the UGT76G1 polypeptide can be encoded by the nucleotide sequence set forth in SEQ ID NO:8, the UGT74G1 polypeptide can be encoded by the nucleotide sequence set forth in SEQ ID NO:3, the UGT91D2e polypeptide can be encoded by the nucleotide sequence set forth in SEQ ID NO:10, the UGT91D2e-b polypeptide can be encoded by the nucleotide sequence set forth in SEQ ID NO:12, and the EUGT11 polypeptide can be encoded by the nucleotide sequence set forth in SEQ ID NO:14 or SEQ ID NO:15. The skilled worker will appreciate that expression of these genes may be necessary to produce a particular steviol glycoside but that one or more of these genes can be endogenous to the host provided that at least one (and in some embodiments, all) of these genes is a recombinant gene introduced into the recombinant host. In a particular embodiment, a steviol-producing recombinant microorganism comprises exogenous nucleic acids encoding UGT85C2, UGT76G1, or UGT91D2 polypeptides.

In another particular embodiment, a steviol-producing recombinant microorganism comprises exogenous nucleic acids encoding UGT85C2, UGT76G1, UGT74G1, and UGT91D2 polypeptides. In yet another particular embodiment, a steviol-producing recombinant microorganism comprises exogenous nucleic acids encoding UGT85C2, UGT76G1, UGT74G1, and EUGT11 polypeptides. In yet another particular embodiment, a steviol-producing recombinant microorganism comprises exogenous nucleic acids encoding UGT85C2, UGT76G1, UGT74G1, UGT91D2 (including inter alia UGT91D2e, UGT91D2m, UGT91D2e-b, and functional homologs thereof), and EUGT11 polypeptides. In yet another particular embodiment, a steviol-producing recombinant microorganism comprises exogenous nucleic acids encoding UGT85C2, UGT76G1, UGT74G1, UGT91D2, and/or EUGT11 polypeptides. In yet another particular embodiment, a steviol-producing recombinant microorganism comprises exogenous nucleic acids encoding UGT85C2, UCT76G1, UGT74G1, UGT91D2, and/or EUGT11 polypeptides.

In some embodiments, a recombinant host comprises: (a) a gene encoding a polypeptide capable of beta 1,2 glucosylation of the C2' of the 19-O glucose of a steviol glycoside; (b) a gene encoding a polypeptide capable of beta 1,2 glucosylation of the C2' of the 13-O-glucose of a steviol glycoside; (c) a gene encoding a polypeptide capable of beta 1,3 glucosylation of the C3' of the 19-O-glucose of a steviol glycoside; (d) a gene encoding a polypeptide capable of beta 1,3 glucosylation of the C3' of the 13-O-glucose of a steviol glycoside; (e) a gene encoding a polypeptide capable of beta 1,6 glucosylation of the C6' of the 13-O-glucose of a steviol glycoside; (f) a gene encoding a polypeptide capable of beta 1,6 glucosylation of the C6' of the 1,3-glucose of a 13-O diglucoside moiety of a steviol glycoside; (g) a gene encoding a polypeptide capable of glucosylation of the 13-OH of steviol or a steviol glycoside; (h) a gene encoding a polypeptide capable of glucosylation of the C-19 carboxyl of steviol or a steviol glycoside; (i) a gene encoding a polypeptide capable of beta 1,2 rhamnosylation of the C2' of the 13-O-glucose of a steviol glycoside; (j) a gene encoding a polypeptide capable of beta 1,2 xylosylation of the C2' of the 13-O-glucose of a steviol glycoside; (o) a gene encoding a polypeptide capable of beta 1,2 GlcNAc transfer to the C2' of the 19-O glucose of a steviol glycoside; (k) a gene encoding a polypeptide capable of beta 1,3 GlcNAc transfer to the C2' of the 19-O glucose of a steviol glycoside; (I) a gene encoding a polypeptide capable of beta 1,3 GlcNAc transfer to the C2' of the 13-O-glucose of a steviol glycoside; (m) a gene encoding a polypeptide capable of GlcNAc transfer to the C-19 carboxyl of steviol or a steviol glycoside; (n) a gene encoding a polypeptide capable of glucosylation of the C-19 carboxyl of kaurenoic acid or kaurenol; (o) a gene encoding a polypeptide capable of beta 1,2 glucosylation of the C2' of the 19-O glucose of a kaurenoic acid glycoside or kaurenol glycoside; (p) a gene encoding a polypeptide capable of a beta 1,2 glucosylation of a beta 1,2 diglucoside of kaurenoic acid; (q) a gene encoding a polypeptide capable of beta 1,2 GlcNAc transfer of a beta 1,2 diglucoside of kaurenoic acid; (r) a gene encoding a polypeptide capable of beta 1,3 glucosylation of the C3' of the 19-O-glucose of a kaurenoic acid glycoside or kaurenol glycoside; and/or (s) a gene encoding a polypeptide capable of beta 1,6 glucosylation of the C6' of the 1,3-glucose of a 19-O diglucoside moiety of a steviol glycoside.

Figure 3:
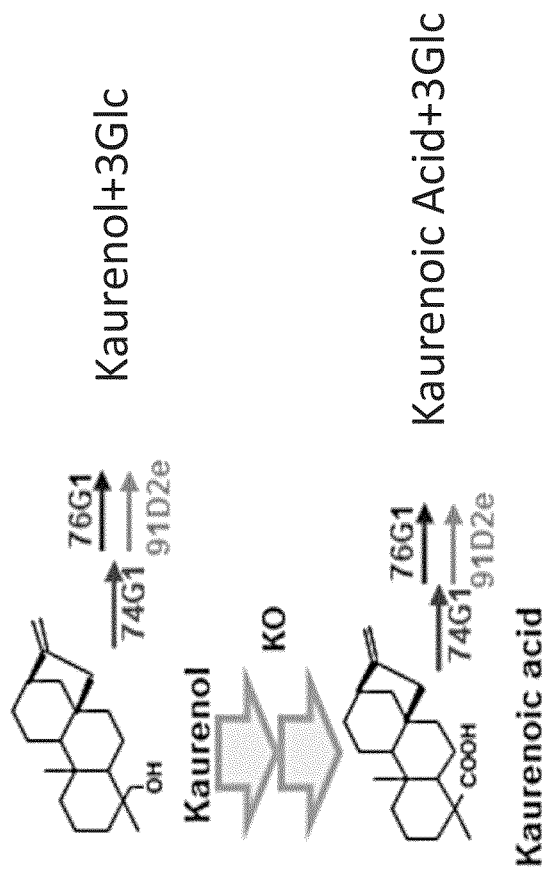
FIG. 3 shows the steviol synthetic intermediate, ent-kaurenol, and its bioconversion product, ent-kaurenoic acid, for the steviol pathway step catalyzed by a KO, along with potential glycosylation by-products (mono-, di-, and/or tri-glycosylated ent-kaurenol and mono-, di-, or tri-glycosylated ent-kaurenoic acid).

In some aspects, EUGT11 (SEQ ID NO:14/SEQ ID NO:15, SEQ ID NO:16), UGT91D2e (SEQ ID NO:10, SEQ ID NO:11), UGT91D2e-b (SEQ ID NO:12, SEQ ID NO:13), a variant thereof, or a chimeric protein thereof catalyzes beta 1,2 glucosylation of the C2' of the 19-O glucose of a steviol glycoside. Exemplary UGT91D2e variant sequences are set forth in SEQ ID NOs:1, 2, 118-121, 123, and 191-214. In some aspects, UGT91D2e (SEQ ID NO:10, SEQ ID NO:11), UGT91D2e-b (SEQ ID NO:12, SEQ ID NO:13), a variant thereof, or a chimeric protein thereof catalyzes beta 1,2 glucosylation of the C2' of the 13-O-glucose of a steviol glycoside. Exemplary UGT91D2e variant sequences are set forth in SEQ ID NOs:1, 2, 118-121, 123, and 191-214. Exemplary UGT91D2e-EUGT11 chimeric protein sequences are set forth in SEQ ID NO:17 and SEQ ID NO:18. In some aspects, UGT76G1 (SEQ ID NO:8, SEQ ID NO:9), a variant thereof, or a chimeric protein thereof catalyzes beta 1,3 glucosylation of the C3' of the 19-O-glucose of a steviol glycoside and/or beta 1,3 glucosylation of the C3' of the 13-O-glucose of a steviol glycoside. Exemplary UGT76G1 variant sequences are set forth in SEQ ID NOs:181-190 and 217-220. In some aspects, UGT85C2 (SEQ ID NO:5/SEQ ID NO:6, SEQ ID NO:7), a variant thereof, or a chimeric protein thereof catalyzes glucosylation of the 13-OH of steviol or a steviol glycoside. Exemplary UGT85C2 variant sequences are set forth in SEQ ID NOs:127 and 147-180. In some aspects, UGT74G1 (SEQ ID NO:3, SEQ ID NO:4), a variant thereof, or a chimeric protein thereof catalyzes glucosylation of the C-19 carboxyl of steviol or a steviol glycoside. In some aspects, EUGT11 (SEQ ID NO:14/SEQ ID NO:15, SEQ ID NO:16), UGT91D2e (SEQ ID NO:10, SEQ ID NO:11), UGT74G1 (SEQ ID NO:3, SEQ ID NO:4), and/or UGT76G1 (SEQ ID NO:8, SEQ ID NO:9 can accept uridine diphosphate N-acetylglucosamine (UDP-Glc-NAc) as a substrate. In some aspects, UGT74G1 glycosylates ent-kaurenol and ent-kaurenoic acid; UGT76G1 and UGT91D2e subsequently add additional glucose or GlcNAc moieties by either a 1,3- or 1,2-linkage to form tri-glycosylated compounds. See FIGS. 3, 7 and 8.

In some embodiments, steviol glycosides and/or steviol glycoside precursors are produced through contact of a steviol glycoside precursor with one or more enzymes involved in the steviol glycoside pathway in vitro. For example, contacting steviol with a UGT polypeptide can result in production of a steviol glycoside in vitro. In some embodiments, a steviol glycoside precursor is produced through contact of an upstream steviol glycoside precursor with one or more enzymes involved in the steviol glycoside pathway in vitro. For example, contacting ent-kaurenoic acid with a KAH enzyme can result in production of steviol in vitro.

In some embodiments, a steviol glycoside or steviol glycoside precursor is produced by whole cell bioconversion. For whole cell bioconversion to occur, a host cell expressing one or more enzymes involved in the steviol glycoside pathway takes up and modifies a steviol glycoside precursor in the cell; following modification in vivo, a steviol glycoside remains in the cell and/or is excreted into the culture medium. For example, a host cell expressing a gene encoding a UGT polypeptide can take up steviol and glycosylate steviol in the cell; following glycosylation in vivo, a steviol glycoside can be excreted into the culture medium. In some embodiments, the cell is permeabilized to take up a substrate to be modified or to excrete a modified product.

In some embodiments, steviol, one or more steviol glycoside precursors, and/or one or more steviol glycosides are produced by co-culturing of two or more hosts. In some embodiments, one or more hosts, each expressing one or more enzymes involved in the steviol glycoside pathway, produce steviol, one or more steviol glycoside precursors, and/or one or more steviol glycosides. For example, a host comprising a GGPPS, a CDPS, a KO, a KS, a KAH, and/or a CPR and a host comprising one or more UGTs produce one or more steviol glycosides.

In some embodiments, polypeptides suitable for producing steviol glycosides, such as 1,2-stevioside and RebD, in vitro, in a recombinant host, or by whole cell bioconversion include functional homologs of UGT91D2e (SEQ ID NO:10, SEQ ID NO:11), including UGT91D2e-b (SEQ ID NO:12, SEQ ID NO:13); UGT91D2e V286C (SEQ ID NO:1); UGT91D2e G384W (SEQ ID NO:2); UGT91D2e L211M (SEQ ID NO:118); UGT91D2e L195G (SEQ ID NO:119); UGT91D2e V196P (SEQ ID NO:120); UGT91D2e L211H (SEQ ID NO:121); UGT91D2e L213E (SEQ ID NO:191); UGT91D2e S221Y (SEQ ID NO:192); UGT91D2e E438H (SEQ ID NO:193); UGT91D2e M152T (SEQ ID NO:194); UGT91D2e L211C (SEQ ID NO:195); UGT91D2e L195S (SEQ ID NO:196); UGT91D2e L195V (SEQ ID NO:197); UGT91D2e V286S (SEQ ID NO:198); UGT91D2e S221S (SEQ ID NO:199); UGT91D2e P93V M152G (SEQ ID NO:200); UGT91D2e S99I (SEQ ID NO:201); UGT91D2e T144K P201P (SEQ ID NO:202); UGT91D2e T144L (SEQ ID NO:203); UGT91D2e T144M (SEQ ID NO:204); UGT91D2e A148K L211I (SEQ ID NO:205); UGT91D2e L195N (SEQ ID NO:206); UGT91D2e K199C (SEQ ID NO:207); UGT91D2e L211M E426G A466V (SEQ ID NO:208); UGT91D2e L211T I303I (SEQ ID NO:209); UGT91D2e V286N (SEQ ID NO:210);

UGT91D2e S114F V286S (SEQ ID NO:211); UGT91D2e G384K (SEQ ID NO:212); UGT91D2e G384Y (SEQ ID NO:213); UGT91D2e E438M (SEQ ID NO:214); and UGT91D2e L195C (SEQ ID NO:123). See Example 3.

In some embodiments, a useful UGT91D2 homolog can have one or more amino acid substitutions at residues 195, 196, 211, 286, and 384. See Table 2. Non-limiting examples of useful UGT91D2e homologs include polypeptides having substitutions (with respect to SEQ ID NO:11) at residue 93 (e.g., a valine at residue 93); 99 (e.g., an isoleucine at residue 99), 114 (e.g., a phenylalanine at residue 114); 144 (e.g., a lysine, leucine, or methionine at residue 144); 148 (e.g., a lysine at residue 148); 152 (e.g., a threonine at residue 152); 195 (e.g., a glycine, cysteine, serine, arginine, or valine at residue 195); 196 (e.g., a proline at residue 196); 199 (e.g., a cysteine at residue 199); 211 (e.g., a methionine, histidine, threonine, cysteine, or isoleucine at residue 211); 213 (e.g., a glutamic acid at 213); 221 (e.g., an isoleucine at residue 221); 286 (e.g., an alanine, cysteine, asparagine, or serine at residue 286); 384 (e.g., a tryptophan, lysine, or tyrosine at residue 384); 426 (e.g., a glycine at residue 426); 438 (e.g., a histidine or methionine at residue 438); or 466 (e.g., a valine at residue 466). See Example 3.

In some embodiments, UGT91D2e variants comprise silent mutations. For example, in some embodiments, UGT91D2e variants comprise silent mutations at residues not limited to residue 130, residue 201, or residue 221. See Example 3.

In some embodiments, UGT91D2e variants not limited to UGT91D2e V286C (SEQ ID NO:1), UGT91D2e G384W (SEQ ID NO:2), UGT91D2e L195V (SEQ ID NO:197), UGT91D2e V286S (SEQ ID NO:198), UGT91D2e T144K P201P (SEQ ID NO:202), UGT91D2e L211T I130I (SEQ ID NO:184), UGT91D2e S11F V286S (SEQ ID NO:211), and UGT91D2e E438M (SEQ ID NO:214) are selective towards rubusoside, with preferential accumulation of 1,2-stevioside. In some embodiments, UGT91D2e variants not limited to UGTD1D2e P93V M152G (SEQ ID NO:200), UGT91D2e S991 (SEQ ID NO:201), UGT91D2e T144L (SEQ ID NO:203), UGT91D2e A148K L221I (SEQ ID NO:205), and UGT91D2e G384K (SEQ ID NO:212) are selective towards RebA, with preferential accumulation of RebD. In some embodiments, UGT91D2e variants not limited to a UGT91D2e variant with a mutation at residue 211 (e.g., UGT91D2e L211M of SEQ ID NO:118) catalyze conversion of rubusoside to 1,2-stevioside and conversion of RebA to RebD, with preferential accumulation of 1,2-stevioside. See Example 3 and Tables 2 and 3.

In some embodiments, polypeptides suitable for producing steviol glycosides, such as RebA, RebD, rubusoside, and/or 1,2-stevioside in a recombinant host include UGT91D2e-b-EUGT11 chimeric enzymes, such as Chim_3 (SEQ ID NO:17) or Chim_7 (SEQ ID NO:18). See Example 4 and Table 5.

In some embodiments, Chim_7 (SEQ ID NO:18) more efficiently converts rubusoside to 1,2-stevioside, compared to EUGT11 and UGT91D2e. In some embodiments, Chim_7 (SEQ ID NO:18) fully consumes a supplied amount of rubusoside. In some embodiments, Chim_7 (SEQ ID NO:18) demonstrates 1.75-fold higher activity towards RebA than UGT91D2e-b (SEQ ID NO:12, SEQ ID NO:13). In some embodiments, Chim_3 (SEQ ID NO:17) selectively converts rubusoside to 1,2-stevioside. See Example 4 and Table 5.

In some embodiments, UGT91D2e-b-EUGT11 chimeric enzymes such as Chim_2 (SEQ ID NO:122); Chim_4 (SEQ ID NO:124); Chim_5 (SEQ ID NO:125); Chim_6 (SEQ ID NO:126); Chim_7 (SEQ ID NO:18); Chim_8 (SEQ ID NO:128); Chim_9 (SEQ ID NO:129); Chim_10 (SEQ ID NO:130); Chim_11 (SEQ ID NO:131); Chim_12 (SEQ ID NO:132); Chim_13 (SEQ ID NO:133); Chim_14 (SEQ ID NO:134) are used to produce steviol glycosides and/or steviol glycoside precursors.

In some embodiments, a useful UGT85C2 homolog can have one or more amino acid substitutions at residues 21, 48, 49, 84, 86, 87, 91, 92, 95, 122, 304, and 334. See Table 7. Non-limiting examples of useful UGT85C2 homologs include polypeptides having substitutions (with respect to SEQ ID NO:7) at residue 21 (e.g., a lysine, threonine, or valine at residue 21), 48 (e.g., a serine, histidine, tyrosine, arginine, glutamine, or tryptophan at residue 48), 49 (e.g., a valine at residue 49), 84 (e.g., a glycine, alanine, threonine, cysteine, proline, valine, or asparagine at residue 84), 86 (e.g., an arginine or glycine at residue 86); 87 (e.g., an histidine, proline, methionine or tyrosine at residue 87); 91 (e.g., an lysine, arginine, or threonine at residue 91); 92 (e.g., an phenylalanine, isoleucine, methionine, or lysine at residue 92); 122 (e.g., an serine at residue 122); 304 (e.g., an serine at residue 304); and 334 (e.g., an serine or methionine at residue 334). See SEQ ID NOs:127 and 147-180, Table 7A for UGT85C2 variants analyzed that preferentially catalyze conversion of 19-SMG over conversion of steviol, Table 7B for UGT85C2 variants that preferentially catalyze conversion of steviol over conversion of 19-SMG, and Table 7C for additional UGT85C2 variants that catalyze conversion of 19-SMG and steviol. Also see Example 5.

In some embodiments, a steviol glycoside-producing S. cerevisiae strain comprising a recombinant gene encoding a Synechococcus sp. GGPPS polypeptide (SEQ ID NO:19, SEQ ID NO:20), a recombinant gene encoding a truncated Z. mays CDPS polypeptide (SEQ ID NO:39, SEQ ID NO:40), a recombinant gene encoding an A. thaliana KS polypeptide (SEQ ID NO:51, SEQ ID NO:52), a recombinant gene encoding a recombinant S. rebaudiana KO polypeptide (SEQ ID NO:59, SEQ ID NO:60), a recombinant gene encoding an A. thaliana ATR2 polypeptide (SEQ ID NO:91, SEQ ID NO:92), a recombinant gene encoding an O. sativa EUGT11 polypeptide (SEQ ID NO:14/SEQ ID NO:15, SEQ ID NO:16), a recombinant gene encoding an SrKAHe1 polypeptide (SEQ ID NO:93, SEQ ID NO:94), a recombinant gene encoding an S. rebaudiana CPR8 polypeptide (SEQ ID NO:85, SEQ ID NO:86), a recombinant gene encoding an S. rebaudiana UGT74G1 polypeptide (SEQ ID NO:3, SEQ ID NO:4), a recombinant gene encoding an S. rebaudiana UGT76G1 polypeptide (SEQ ID NO:8, SEQ ID NO:9), a recombinant gene encoding an S. rebaudiana UGT91D2e polypeptide (SEQ ID NO:10, SEQ ID NO:11), a recombinant KO gene encoded by the nucleotide sequence set forth in SEQ ID NO:67 (corresponding to the amino acid sequence set forth in SEQ ID NO:117), and a recombinant CPR1 gene encoding (SEQ ID NO:77, SEQ ID NO:78) accumulates ent-kaurenoic acid+2Glc (#7), ent-kaurenoic acid+3Glc (isomer 1), ent-kaurenoic acid+3Glc (isomer 2), 19-SMG, steviol, steviol+2Glc (#23), and steviol+3Glc (#34) but does not accumulate ent-kaurenol glycosides. See Example 6 and FIGS. 4A-4C.

In some embodiments, the S84V F48S, F48H, F48Y, F48R, F48Q, F48T, F48S, 149V, P86R, P86G, and F122S variants of UGT85C2 are selective towards 19-SMG, compared to steviol (Table 7A). In some embodiments, the S84T, 187M 187P, 187Y, L91K, L91R, L91T, L92M, and 195K variants of UGT85C2 are selective towards steviol, compared to 19-SMG (Table 7B). In some embodiments, expression of UGT85C2 T3045 (SEQ ID NO:127) in a steviol glycoside-producing host increases accumulation of steviol glycosides, compared to a steviol glycoside-producing host not expressing UGT85C2 T3045 (SEQ ID NO:127). See Example 5.

In some embodiments, cell lysates comprising UGT85C2 or a UGT85C2 variant show a preference for either steviol or 19-SMG for a substrate. In some aspects, using steviol as a substrate, the F48H, F48Y, F48T, I49V, S84A, and L92F UGT85C2 variants exhibit high activity during incubation periods of under 40 min, and the F48H, F48Y, F48T, and I49V UGT85C2 variants exhibit high activity during incubation periods of over 40 min (Table 8A). Using 19-SMG as a substrate, the F48H, F48Y, F48T, I49V, and S84A UGT85C2 variants exhibit high activity during incubation periods of under 40 min, and the F48H, I49V, S84A, S84V, L91K, and L92F UGT85C2 variants, as well as the wild-type UGT85C2, exhibit high activity during incubation periods of over 40 min (Table 8B). In some aspects, the L91K, L91R, and L92F UGT85C2 variants exhibit a high 13-SMG/rubusoside ratio, whereas the F48Y, F48T, P86G UGT85C2 variants exhibit a low 13-SMG/rubusoside ratio. See Example 7.

In some embodiments, a useful UGT76G1 homolog can have one or more amino acid substitutions at residues 23, 26, 55, 146, 257, 283, and 337. See Example 4. Non-limiting examples of useful UGT76G1 homologs include polypeptides having substitutions (with respect to SEQ ID NO:9) at residue 21 (e.g., a lysine, threonine or valine at residue 21), residue 23 (e.g., a histidine at residue 23); residue 26 (e.g., a tryptophan at residue 26); residue 55 (e.g., a lysine at residue 55); residue 146 (e.g., a glycine at residue 146); residue 257 (e.g., a glycine at residue 257); residue 283 (e.g., a asparagine at residue 283); and residue 337 (e.g., a proline at residue 337). See SEQ ID NOs: 181-190. See Table 9 and Examples 8 and 9.

In some embodiments, expression of UGT76G1 variants that increase accumulation of RebD or RebM in steviol glycoside-producing S. cerevisiae strains (see WO 2014/122227, which has been incorporated by reference in its entirety) alter accumulation of 13-SMG, 1,2-bioside, rubusoside, RebA, RebB, RebD, RebE, RebM, RebG (1,3-stevioside), steviol+3Glc (#1), steviol+4Glc (#26), steviol+5Glc (#22), steviol+5Glc (#24), steviol+5Glc (#25), steviol+6Glc (isomer 1), and steviol+6Glc (#23), compared to expression of wild-type UGT76G1 (SEQ ID NO:9) in steviol glycoside-producing S. cerevisiae strains. See FIGS. 6, 10, 11D, and 11E and Examples 8 and 9.

In some embodiments, expression of UGT variants that increase RebD levels in S. cerevisiae also results in increased accumulation of steviol+5Glc (#22), 1,2-stevioside, steviol+6Glc (isomer 1), and steviol+3Glc (#1) but decreased accumulation of steviol+4Glc (#26), steviol+5Glc (#24), and RebG (1,3-stevioside). In some embodiments, expression of UGT76G1 H155L (SEQ ID NO:184) results in increased accumulation of steviol+5Glc (#25) but decreased accumulation of 1,2-stevioside, steviol+3Glc (#1), steviol+4Glc (#26), steviol+5Glc (#22), steviol+6Glc (isomer 1), and steviol+6Glc (#23). In some embodiments, expression of UGT76G1 S253W (SEQ ID NO:186) results in decreased accumulation of 1,2-stevioside and steviol+6Glc (isomer 1). In some embodiments, expression of UGT76G1 284G results in increased accumulation of 1,2-stevioside and steviol+6Glc (isomer 1) but decreased accumulation of RebG, steviol+4Glc (#26), steviol+5Glc (#25), and steviol+6Glc (#23). See FIG. 10 and Example 8.

In some embodiments, expression of UGT76G1 Q23H (SEQ ID NO:181), UGT76G1 I26W (SEQ ID NO:182), UGT76G1 T146G (SEQ ID NO:183), UGT76G1 H155L (SEQ ID NO:184), UGT76G1 L257G (SEQ ID NO:185), and UGT76G1 S283N (SEQ ID NO:188) decrease accumulation of steviol+4Glc (#26). In some embodiments, expression of UGT76G1 Q23H (SEQ ID NO:181), UGT76G1 I26W (SEQ ID NO:182), UGT76G1 T146G (SEQ ID NO:183), UGT76G1 L257G (SEQ ID NO:185), or UGT76G1 S283N (SEQ ID NO:188), all of which increase production of RebD, decrease accumulation of steviol+5Glc (#25), compared to a control strain expressing wild-type UGT76G1. In some embodiments, expression of UGT76G1 H155L (SEQ ID NO:184), which increases RebM production, increases accumulation of steviol+5Glc (#25). See FIG. 11D and Example 8.

In some embodiments, expression of UGT76G1 Q23H (SEQ ID NO:181), UGT76G1 I26W (SEQ ID NO:182), UGT76G1 T146G (SEQ ID NO:183), UGT76G1 L257G (SEQ ID NO:185), or UGT76G1 S283N (SEQ ID NO:188) increases accumulation of steviol+6Glc (#23), compared to a control strain expressing wild-type UGT76G1. In some embodiments, expression of UGT76G1 H155L (SEQ ID NO:184) decreases accumulation of steviol+6Glc (#23). In some embodiments, expression of UGT76G1 Q23H (SEQ ID NO:181), UGT76G1 I26W (SEQ ID NO:182), UGT76G1 T146G (SEQ ID NO:183), UGT76G1 L257G (SEQ ID NO:185), or UGT76G1 S283N (SEQ ID NO:188) increases accumulation of steviol+7Glc (isomer 2), compared to a control strain expressing wild-type UGT76G1. In some embodiments, expression of UGT76G1 H155L (SEQ ID NO:184) decreases accumulation of steviol+7Glc (isomer 2). In some embodiments, expression of UGT76G1 Q23H (SEQ ID NO:181), UGT76G1 I26W (SEQ ID NO:182), UGT76G1 T146G (SEQ ID NO:183), UGT76G1 L257G (SEQ ID NO:185), or UGT76G1 S283N (SEQ ID NO:188) increases accumulation of steviol+7Glc (isomer 5). See FIG. 11D and Example 8.

In some embodiments, a host expressing a gene encoding a UGT variant or UGT chimeric polypeptide produces an increased level of glycosylated ent-kaurenoic acid and/or ent-kaurenol relative to a host not expressing a gene encoding a UGT variant or UGT chimeric polypeptide. In some embodiments, the UGT variant or UGT chimeric polypeptide comprises a UGT91D2e variant, a gene encoding a UGT91D2e-b-EUGT11 chimeric polypeptide, a gene encoding a UGT85C2 variant, and/or a gene encoding a UGT76G1 variant.

In some embodiments, a host expressing a gene encoding a UGT variant or UGT chimeric polypeptide produces a decreased level of glycosylated ent-kaurenoic acid and/or ent-kaurenol relative to a host not expressing a gene encoding a UGT variant or UGT chimeric polypeptide. In some embodiments, the UGT variant or UGT chimeric polypeptide comprises a UGT91D2e variant, a gene encoding a UGT91D2e-b-EUGT11 chimeric polypeptide, a gene encoding a UGT85C2 variant, and/or a gene encoding a UGT76G1 variant.

In some embodiments, levels of ent-kaurenoic acid+2Glc (#7), ent-kaurenoic acid+3Glc (isomer 1), ent-kaurenoic acid+3Glc (isomer 2), ent-kaurenol+2Glc (#8), and ent-kaurenol+3Glc (isomer 1) co-eluted with ent-kaurenol+3Glc (#6) are altered in steviol glycoside-producing S. cerevisiae strains expressing wild-type UGT76G1 (SEQ ID NO:9), compared to S. cerevisiae strains expressing UGT76G1 Q23H (SEQ ID NO:181), UGT76G1 I26W (SEQ ID NO:182), UGT76G1 T146G (SEQ ID NO:183), UGT76G1 H155L (SEQ ID NO:184), UGT76G1 L257G (SEQ ID NO:185), UGT76G1 S253W (SEQ ID NO:186), UGT76G1

T284G (SEQ ID NO:187), UGT76G1 S283N (SEQ ID NO:188), UGT76G1 K337P (SEQ ID NO:189), or UGT76G1 T55K (SEQ ID NO:190). See FIG. 9, FIGS. 11A-11C, and Example 8.

In some embodiments, *S. cerevisiae* strains expressing UGT76G1 variants that increase RebD levels also increase accumulation of ent-kaurenoic acid+2Glc (#7) and ent-kaurenoic acid+2Glc (isomer 1) but decrease accumulation of ent-kaurenoic acid+3Glc (isomer 2), compared to an *S. cerevisiae* strain expressing wild-type UGT76G1. In some embodiments, UGT76G1 variants that increase RebD levels also increase accumulation of ent-kaurenol+2Glc (#8) but decrease accumulation of ent-kaurenol+3Glc (isomer 1) co-eluted with ent-kaurenol+3Glc (#6). In some embodiments, expression of UGT76G1 H155L (SEQ ID NO:184), a variant that increases levels of RebM, decreases accumulation of ent-kaurenoic acid+2Glc (#7) and ent-kaurenoic acid+3Glc (isomer 1). See FIG. 9 and Example 8.

In some embodiments, total levels of glycosylated ent-kaurenoic acid (ent-kaurenoic acid+2Glc (#7)+ent-kaurenoic acid+3Glc (isomer 1)+ent-kaurenoic acid+3Glc (isomer 2)) are increased in steviol glycoside-producing *S. cerevisiae* strains expressing UGT76G1 Q23H (SEQ ID NO:181), UGT76G1 I26W (SEQ ID NO:182), and UGT L257G (SEQ ID NO:185). In some embodiments, total levels of glycosylated ent-kaurenol (ent-kaurenol+3Glc (isomer 1) co-eluted with ent-kaurenol+3Glc (#6) and ent-kaurenol+2Glc (#8) are altered for in steviol glycoside-producing *S. cerevisiae* strains expressing UGT76G1 Q23H (SEQ ID NO:181), UGT76G1 I26W (SEQ ID NO:182), and UGT76G1 T146G (SEQ ID NO:183). See FIGS. 11B and 11C and Example 8.

In some embodiments, UGT variants not limited to variants of UGT76G1, UGT85C2, and/or UGT91D2e alter ratios of steviol glycosides produced to GlcNAc compounds and isomers thereof produced in vitro, in vivo in a host, and/or by whole cell bioconversion.

Exemplary GlcNAc structures include ent-kaurenoic acid+2Glc+1GlcNAc and steviol+4Glc+1GlcNAc (#11). See, e.g., FIGS. 7A, 7D, 8G-8I, and 8AC-8AF and Examples 6, 8, and 9.

In some embodiments, a steviol glycoside or steviol glycoside precursor composition produced in vivo, in vitro, or by whole cell bioconversion comprises fewer contaminants or less of any particular contaminant than a *stevia* extract from, inter alia, a *stevia* plant. Contaminants can include plant-derived compounds that contribute to off-flavors. Potential contaminants include pigments, lipids, proteins, phenolics, saccharides, spathulenol and other sesquiterpenes, labdane diterpenes, monoterpenes, decanoic acid, 8,11,14-eicosatrienoic add, 2-methyloctadecane, pentacosane, octacosane, tetracosane, octadecanol, stigmasterol, β-sitosterol, α-amyrin, β-amyrin, lupeol, β-amryin acetate, pentacyclic triterpenes, centauredin, quercitin, epi-alpha-cadinol, carophyllenes and derivatives, beta-pinene, beta-sitosterol, and gibberellins.

As used herein, the terms "detectable amount," "detectable concentration," "measurable amount," and "measurable concentration" refer to a level of steviol glycosides measured in area-under-curve (AUC), $\mu M/OD_{600}$, mg/L, $\mu M$, or mM. Steviol glycoside production (i.e., total, supernatant, and/or intracellular steviol glycoside levels) can be detected and/or analyzed by techniques generally available to one skilled in the art, for example, but not limited to, liquid chromatography-mass spectrometry (LC-MS), thin layer chromatography (TLC), high-performance liquid chromatography (HPLC), ultraviolet-visible spectroscopy/spectrophotometry (UV-Vis), mass spectrometry (MS), and nuclear magnetic resonance spectroscopy (NMR).

As used herein, the term "undetectable concentration" refers to a level of a compound that is too low to be measured and/or analyzed by techniques such as TLC, HPLC, UV-Vis, MS, or NMR. In some embodiments, a compound of an "undetectable concentration" is not present in a steviol glycoside or steviol glycoside precursor composition.

As used herein, the terms "or" and "and/or" is utilized to describe multiple components in combination or exclusive of one another. For example, "x, y, and/or z" can refer to "x" alone, "y" alone, "z" alone, "x, y, and z," "(x and y) or z," "x or (y and z)," or "x or y or z." In some embodiments, "and/or" is used to refer to the exogenous nucleic acids that a recombinant cell comprises, wherein a recombinant cell comprises one or more exogenous nucleic acids selected from a group. In some embodiments, "and/or" is used to refer to production of steviol glycosides and/or steviol glycoside precursors. In some embodiments, "and/or" is used to refer to production of steviol glycosides, wherein one or more steviol glycosides are produced. In some embodiments, "and/or" is used to refer to production of steviol glycosides, wherein one or more steviol glycosides are produced through one or more of the following steps: culturing a recombinant microorganism, synthesizing one or more steviol glycosides in a recombinant microorganism, and/or isolating one or more steviol glycosides.

Functional Homologs

Functional homologs of the polypeptides described above are also suitable for use in producing steviol glycosides in a recombinant host. A functional homolog is a polypeptide that has sequence similarity to a reference polypeptide, and that carries out one or more of the biochemical or physiological function(s) of the reference polypeptide. A functional homolog and the reference polypeptide can be a natural occurring polypeptide, and the sequence similarity can be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, can themselves be functional homologs. Functional homologs can also be created via site-directed mutagenesis of the coding sequence for a polypeptide, or by combining domains from the coding sequences for different naturally-occurring polypeptides ("domain swapping"). Techniques for modifying genes encoding functional polypeptides described herein are known and include, inter alia, directed evolution techniques, site-directed mutagenesis techniques and random mutagenesis techniques, and can be useful to increase specific activity of a polypeptide, alter substrate specificity, alter expression levels, alter subcellular location, or modify polypeptide-polypeptide interactions in a desired manner. Such modified polypeptides are considered functional homologs. The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of steviol glycoside biosynthesis polypeptides. Sequence analysis can involve BLAST, Reciprocal BLAST, or PSI-BLAST analysis of non-redundant databases using a UGT amino acid sequence as the reference sequence. Amino acid sequence is, in some instances, deduced from the nucleotide sequence.

Those polypeptides in the database that have greater than 40% sequence identity are candidates for further evaluation for suitability as a steviol glycoside biosynthesis polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in steviol glycoside biosynthesis polypeptides, e.g., conserved functional domains. In some embodiments, nucleic acids and polypeptides are identified from transcriptome data based on expression levels rather than by using BLAST analysis.

Conserved regions can be identified by locating a region within the primary amino acid sequence of a steviol glycoside biosynthesis polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wde Web at sanger.ac.uk/Software/Pfam/ and pfam.janelia.org/. The information included at the Pfam database is described in Sonnhammer et al., *Nucl. Acids Res.*, 26:320-322 (1998); Sonnhammer et al., Proteins, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate to identify such homologs.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

For example, polypeptides suitable for producing steviol in a recombinant host include functional homologs of UGTs.

Methods to modify the substrate specificity of, for example, a UGT, are known to those skilled in the art, and include without limitation site-directed/rational mutagenesis approaches, random directed evolution approaches and combinations in which random mutagenesis/saturation techniques are performed near the active site of the enzyme. For example see Osmani et al., 2009, *Phytochemistry* 70: 325-347.

A candidate sequence typically has a length that is from 80% to 200% of the length of the reference sequence, e.g., 82, 85, 87, 89, 90, 93, 95, 97, 99, 100, 105, 110, 115, 120, 130, 140, 150, 160, 170, 180, 190, or 200% of the length of the reference sequence. A functional homolog polypeptide typically has a length that is from 95% to 105% of the length of the reference sequence, e.g., 90, 93, 95, 97, 99, 100, 105, 110, 115, or 120% of the length of the reference sequence, or any range between. A % identity for any candidate nucleic acid or polypeptide relative to a reference nucleic acid or polypeptide can be determined as follows. A reference sequence (e.g., a nucleic acid sequence or an amino acid sequence described herein) is aligned to one or more candidate sequences using the computer program Clustal Omega (version 1.2.1, default parameters), which allows alignments of nucleic acid or polypeptide sequences to be carried out across their entire length (global alignment). Chenna et al., 2003, *Nucleic Acids Res.* 31(13):3497-500.

Clustal Omega calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: % age; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: % age; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The Clustal Omega output is a sequence alignment that reflects the relationship between sequences. Clustal Omega can be run, for example, at the Baylor College of Medicine Search Launcher site on the World Wde Web (searchlauncher.bcm.tmc.edu/multi-align/multi-align.html) and at the European Bioinformatics Institute site at http://www.ebi.ac.uk/Tools/msa/clustalo/.

To determine a % identity of a candidate nucleic acid or amino acid sequence to a reference sequence, the sequences are aligned using Clustal Omega, the number of identical matches in the alignment is divided by the length of the reference sequence, and the result is multiplied by 100. It is noted that the % identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

It will be appreciated that functional UGT proteins can include additional amino acids that are not involved in the enzymatic activities carried out by the enzymes. In some embodiments, UGT proteins are fusion proteins. The terms "chimera," "fusion polypeptide," "fusion protein," "fusion enzyme," "fusion construct," "chimeric protein," "chimeric polypeptide," "chimeric construct," and "chimeric enzyme" can be used interchangeably herein to refer to proteins engineered through the joining of two or more genes that code for different proteins. In some embodiments, a nucleic acid sequence encoding a UGT polypeptide can include a tag sequence that encodes a "tag" designed to facilitate subsequent manipulation (e.g., to facilitate purification or detection), secretion, or localization of the encoded polypeptide. Tag sequences can be inserted in the nucleic acid sequence encoding the polypeptide such that the encoded tag is located at either the carboxyl or amino terminus of the polypeptide. Non-limiting examples of encoded tags include green fluorescent protein (GFP), human influenza hemagglutinin (HA), glutathione S transferase (GST), polyhistidine-tag (HIS tag), and Flag™ tag (Kodak, New Haven, Conn.). Other examples of tags include a chloroplast transit peptide, a mitochondrial transit peptide, an amyloplast peptide, signal peptide, or a secretion tag.

In some embodiments, a fusion protein is a protein altered by domain swapping. As used herein, the term "domain swapping" is used to describe the process of replacing a domain of a first protein with a domain of a second protein. In some embodiments, the domain of the first protein and the domain of the second protein are functionally identical or functionally similar. In some embodiments, the structure and/or sequence of the domain of the second protein differs from the structure and/or sequence of the domain of the first protein. In some embodiments, a UGT polypeptide is altered by domain swapping.

Steviol and Steviol Glycoside Biosynthesis Nucleic Acids

A recombinant gene encoding a polypeptide described herein comprises the coding sequence for that polypeptide, operably linked in sense orientation to one or more regulatory regions suitable for expressing the polypeptide. Because many microorganisms are capable of expressing multiple gene products from a polycistronic mRNA, multiple polypeptides can be expressed under the control of a single regulatory region for those microorganisms, if desired. A coding sequence and a regulatory region are considered to be operably linked when the regulatory region and coding sequence are positioned so that the regulatory region is effective for regulating transcription or translation of the sequence. Typically, the translation initiation site of the translational reading frame of the coding sequence is positioned between one and about fifty nucleotides downstream of the regulatory region for a monocistronic gene.

In many cases, the coding sequence for a polypeptide described herein is identified in a species other than the recombinant host, i.e., is a heterologous nucleic acid. Thus, if the recombinant host is a microorganism, the coding sequence can be from other prokaryotic or eukaryotic microorganisms, from plants or from animals. In some case, however, the coding sequence is a sequence that is native to the host and is being reintroduced into that organism. A native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. "Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). A regulatory region is operably linked to a coding sequence by positioning the regulatory region and the coding sequence so that the regulatory region is effective for regulating transcription or translation of the sequence. For example, to operably link a coding sequence and a promoter sequence, the translation initiation site of the translational reading frame of the coding sequence is typically positioned between one and about fifty nucleotides downstream of the promoter. A regulatory region can, however, be positioned as much as about 5,000 nucleotides upstream of the translation initiation site, or about 2,000 nucleotides upstream of the transcription start site.

The choice of regulatory regions to be included depends upon several factors, including, but not limited to, efficiency, selectability, inducibility, desired expression level, and preferential expression during certain culture stages. It is a routine matter for one of skill in the art to modulate the expression of a coding sequence by appropriately selecting and positioning regulatory regions relative to the coding sequence. It will be understood that more than one regulatory region may be present, e.g., introns, enhancers, upstream activation regions, transcription terminators, and inducible elements.

One or more genes can be combined in a recombinant nucleic acid construct in "modules" useful for a discrete aspect of steviol and/or steviol glycoside production. Combining a plurality of genes in a module, particularly a polycistronic module, facilitates the use of the module in a variety of species. For example, a steviol biosynthesis gene cluster, or a UGT gene cluster, can be combined in a polycistronic module such that, after insertion of a suitable regulatory region, the module can be introduced into a wide variety of species. As another example, a UGT gene cluster can be combined such that each UGT coding sequence is operably linked to a separate regulatory region, to form a UGT module. Such a module can be used in those species for which monocistronic expression is necessary or desirable. In addition to genes useful for steviol or steviol glycoside production, a recombinant construct typically also contains an origin of replication, and one or more selectable markers for maintenance of the construct in appropriate species.

It will be appreciated that because of the degeneracy of the genetic code, a number of nucleic acids can encode a particular polypeptide; i.e., for many amino acids, there is more than one nucleotide triplet that serves as the codon for the amino acid. Thus, codons in the coding sequence for a given polypeptide can be modified such that optimal expression in a particular host is obtained, using appropriate codon bias tables for that host (e.g., microorganism). As isolated nucleic acids, these modified sequences can exist as purified molecules and can be incorporated into a vector or a virus for use in constructing modules for recombinant nucleic acid constructs.

In some cases, it is desirable to inhibit one or more functions of an endogenous polypeptide in order to divert metabolic intermediates towards steviol or steviol glycoside biosynthesis. For example, it may be desirable to downregulate synthesis of sterols in a yeast strain in order to further increase steviol or steviol glycoside production, e.g., by downregulating squalene epoxidase. As another example, it may be desirable to inhibit degradative functions of certain endogenous gene products, e.g., glycohydrolases that remove glucose moieties from secondary metabolites or phosphatases as discussed herein. In such cases, a nucleic acid that overexpresses the polypeptide or gene product may be included in a recombinant construct that is transformed into the strain. Alternatively, mutagenesis can be used to generate mutants in genes for which it is desired to increase or enhance function.

Host Microorganisms

Recombinant hosts can be used to express polypeptides for the producing steviol glycosides. A number of prokaryotes and eukaryotes are suitable for use in constructing the recombinant microorganisms described herein, e.g., gram-negative bacteria, fungi (i.e., yeast), mammalian, insect, plant, and algae cells. A species and strain selected for use as a steviol glycoside production strain is first analyzed to determine which production genes are endogenous to the strain and which genes are not present. Genes for which an endogenous counterpart is not present in the strain are advantageously assembled in one or more recombinant constructs, which are then transformed into the strain in order to supply the missing function(s).

Typically, the recombinant microorganism is grown in a fermenter at a temperature(s) for a period of time, wherein the temperature and period of time facilitate the production of a steviol glycoside. The constructed and genetically engineered microorganisms provided by the invention can be cultivated using conventional fermentation processes, including, inter alia, chemostat, batch, fed-batch cultivations, semi-continuous fermentations such as draw and fill, continuous perfusion fermentation, and continuous perfusion cell culture. Depending on the particular microorganism used in the method, other recombinant genes such as isopentenyl biosynthesis genes and terpene synthase and cyclase genes may also be present and expressed. Levels of substrates and intermediates, e.g., isopentenyl diphosphate, dimethylallyl diphosphate, GGPP, ent-kaurene and ent-kaurenoic acid, can be determined by extracting samples from culture media for analysis according to published methods.

Carbon sources of use in the instant method include any molecule that can be metabolized by the recombinant host cell to facilitate growth and/or production of the steviol glycosides. Examples of suitable carbon sources include, but are not limited to, sucrose (e.g., as found in molasses), fructose, xylose, ethanol, glycerol, glucose, cellulose, starch, cellobiose or other glucose-comprising polymer. In embodiments employing yeast as a host, for example, carbons sources such as sucrose, fructose, xylose, ethanol, glycerol, and glucose are suitable. The carbon source can be provided to the host organism throughout the cultivation period or alternatively, the organism can be grown for a period of time in the presence of another energy source, e.g., protein, and then provided with a source of carbon only during the fed-batch phase.

After the recombinant microorganism has been grown in culture for the period of time, wherein the temperature and period of time facilitate the production of a steviol glycoside, steviol and/or one or more steviol glycosides can then be recovered from the culture using various techniques known in the art. In some embodiments, a permeabilizing agent can be added to aid the feedstock entering into the host and product getting out. For example, a crude lysate of the cultured microorganism can be centrifuged to obtain a supernatant. The resulting supernatant can then be applied to a chromatography column, e.g., a C-18 column, and washed with water to remove hydrophilic compounds, followed by elution of the compound(s) of interest with a solvent such as methanol. The compound(s) can then be further purified by preparative HPLC. See also, WO 2009/140394.

It will be appreciated that the various genes and modules discussed herein can be present in two or more recombinant hosts rather than a single host. When a plurality of recombinant hosts is used, they can be grown in a mixed culture to accumulate steviol and/or steviol glycosides.

Alternatively, the two or more hosts each can be grown in a separate culture medium and the product of the first culture medium, e.g., steviol, can be introduced into second culture medium to be converted into a subsequent intermediate, or into an end product such as, for example, RebA. The product produced by the second, or final host is then recovered. It will also be appreciated that in some embodiments, a recombinant host is grown using nutrient sources other than a culture medium and utilizing a system other than a fermenter.

Exemplary prokaryotic and eukaryotic species are described in more detail below. However, it will be appreciated that other species can be suitable. For example, suitable species can be in a genus such as *Agaricus, Aspergillus, Bacillus, Candida, Corynebacterium, Eremothecium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces* or *Yarrowia*. Exemplary species from such genera include *Lentinus tigrinus, Laetiporus sulphureus, Phanerochaete chrysosporium, Pichia pastoris, Cyberlindnera jadinii, Physcomitrella patens, Rhodoturula glutinis, Rhodoturula mucilaginosa, Phaffia rhodozyma, Xanthophyllomyces dendrorhous, Fusarium fujikuroi/Gibberella fujikuroi, Candida utilis, Candida glabrata, Candida albicans,* and *Yarrowia lipolytica*.

In some embodiments, a microorganism can be a prokaryote such as *Escherichia* bacteria cells, for example, *Escherichia coli* cells; *Lactobacillus* bacteria cells; *Lactococcus* bacteria cells; *Cornebacterium* bacteria cells; *Acetobacter* bacteria cells; *Acinetobacter* bacteria cells; or *Pseudomonas* bacterial cells.

In some embodiments, a microorganism can be an Ascomycete such as *Gibberella fujikuroi, Kluyveromyces lactis, Schizosaccharomyces pombe, Aspergillus niger, Yarrowia lipolytica, Ashbya gossypii*, or *S. cerevisiae*.

In some embodiments, a microorganism can be an algal cell such as *Blakeslea trispora, Dunaliella salina, Haematococcus pluvialis, Chlorella* sp., *Undaria pinnatifida, Sargassum, Laminaria japonica, Scenedesmus almeriensis* species.

In some embodiments, a microorganism can be a cyanobacterial cell such as *Blakeslea trispora, Dunaliella salina, Haematococcus pluvialis, Chlorella* sp., *Undaria pinnatifida, Sargassum, Laminaria japonica, Scenedesmus almeriensis. Saccharomyces* spp.

*Saccharomyces* is a widely used chassis organism in synthetic biology, and can be used as the recombinant microorganism platform. For example, there are libraries of mutants, plasmids, detailed computer models of metabolism and other information available for *S. cerevisiae*, allowing for rational design of various modules to enhance product yield. Methods are known for making recombinant microorganisms.

*Aspergillus* spp.

*Aspergillus* species such as *A. oryzae, A. niger* and *A. sojae* are widely used microorganisms in food production and can also be used as the recombinant microorganism platform. Nucleotide sequences are available for genomes of *A. nidulans, A. fumigatus, A. oryzae, A. clavatus, A. flavus, A. niger,* and *A. terreus*, allowing rational design and modification of endogenous pathways to enhance flux and increase product yield. Metabolic models have been developed for *Aspergillus*, as well as transcriptomic studies and proteomics studies. *A. niger* is cultured for the industrial production of a number of food ingredients such as citric acid and gluconic acid, and thus species such as *A. niger* are generally suitable for producing steviol glycosides.

*E. coli*

*E. coli*, another widely used platform organism in synthetic biology, can also be used as the recombinant microorganism platform. Similar to *Saccharomyces*, there are libraries of mutants, plasmids, detailed computer models of metabolism and other information available for *E. coli*, allowing for rational design of various modules to enhance product yield. Methods similar to those described above for *Saccharomyces* can be used to make recombinant *E. coli* microorganisms.

*Agaricus, Gibberella,* and *Phanerochaete* spp.

*Agaricus, Gibberella,* and *Phanerochaete* spp. can be useful because they are known to produce large amounts of isoprenoids in culture. Thus, the terpene precursors for producing large amounts of steviol glycosides are already produced by endogenous genes. Thus, modules comprising recombinant genes for steviol glycoside biosynthesis polypeptides can be introduced into species from such genera without the necessity of introducing mevalonate or MEP pathway genes.

*Arxula adeninivorans* (*Blastobotrys adeninivorans*)

*Arxula adeninivorans* is dimorphic yeast (it grows as budding yeast like the baker's yeast up to a temperature of 42° C., above this threshold it grows in a filamentous form) with unusual biochemical characteristics. It can grow on a wide range of substrates and can assimilate nitrate. It has successfully been applied to the generation of strains that can produce natural plastics or the development of a biosensor for estrogens in environmental samples.

*Yarrowia lipolytica*

*Yarrowia lipolytica* is dimorphic yeast (see *Arxula adeninivorans*) and belongs to the family Hemiascomycetes. The entire genome of *Yarrowia lipolytica* is known. *Yarrowia* species is aerobic and considered to be non-pathogenic. *Yarrowia* is efficient in using hydrophobic substrates (e.g. alkanes, fatty acids, oils) and can grow on sugars. It has a high potential for industrial applications and is an oleaginous microorgamism. *Yarrowia lipolyptica* can accumulate lipid content to approximately 40% of its dry cell weight and is a model organism for lipid accumulation and remobilization. See e.g., Nicaud, 2012, Yeast 29(10):409-18; Beopoulos et al., 2009, *Biochimie* 91(6):692-6; Bankar et al., 2009, *Appl Microbiol Biotechnol.* 84(5):847-65.

*Rhodotorula* sp.

*Rhodotorula* is unicellular, pigmented yeast. The oleaginous red yeast, *Rhodotorula glutinis*, has been shown to produce lipids and carotenoids from crude glycerol (Saenge et al., 2011, *Process Biochemistry* 46(1):210-8). *Rhodotorula toruloides* strains have been shown to be an efficient fed-batch fermentation system for improved biomass and lipid productivity (Li et al., 2007, *Enzyme and Microbial Technology* 41:312-7).

*Rhodosporidium toruloides*

*Rhodosporidium toruloides* is oleaginous yeast and useful for engineering lipid-production pathways (See e.g. Zhu et al., 2013, *Nature Commun.* 3:1112; Ageitos et al., 2011, *Applied Microbiology and Biotechnology* 90(4): 1219-27).

*Candida boidinii*

*Candida boidinii* is methylotrophic yeast (it can grow on methanol). Like other methylotrophic species such as *Hansenula polymorpha* and *Pichia pastoris*, it provides an excellent platform for producing heterologous proteins. Yields in a multigram range of a secreted foreign protein have been reported. A computational method, IPRO, recently predicted mutations that experimentally switched the cofactor specificity of *Candida boidinii* xylose reductase from NADPH to NADH. See, e.g., Mattanovich et al., 2012, *Methods Mol Biol.* 824:329-58; Khoury et al., 2009, *Protein Sci.* 18(10):2125-38.

*Hansenula polymorpha* (*Pichia angusta*)

*Hansenula polymorpha* is methylotrophic yeast (see *Candida boidinii*). It can furthermore grow on a wide range of other substrates; it is thermo-tolerant and can assimilate nitrate (see also *Kluyveromyces lactis*). It has been applied to producing hepatitis B vaccines, insulin and interferon alpha-2a for the treatment of hepatitis C, furthermore to a range of technical enzymes. See, e.g., Xu et al., 2014, *Virol Sin.* 29(6):403-9.

*Kluyveromyces lactis*

*Kluyveromyces lactis* is yeast regularly applied to the production of kefir. It can grow on several sugars, most importantly on lactose which is present in milk and whey. It has successfully been applied among others for producing chymosin (an enzyme that is usually present in the stomach of calves) for producing cheese. Production takes place in fermenters on a 40,000 L scale. See, e.g., van Ooyen et al., 2006, *FEMS Yeast Res.* 6(3):381-92.

*Pichia pastoris*

*Pichia pastoris* is methylotrophic yeast (see *Candida boidinii* and *Hansenula polymorpha*). It provides an efficient platform for producing foreign proteins. Platform elements are available as a kit and it is worldwide used in academia for producing proteins. Strains have been engineered that can produce complex human N-glycan (yeast glycans are similar but not identical to those found in humans). See, e.g., Piirainen et al., 2014, *N Biotechnol.* 31(6):532-7.

*Physcomitrella* spp.

*Physcomitrella* mosses, when grown in suspension culture, have characteristics similar to yeast or other fungal cultures. This genera can be used for producing plant secondary metabolites, which can be difficult to produce in other types of cells.

Steviol Glycoside Compositions

Steviol glycosides do not necessarily have equivalent performance in different food systems. It is therefore desirable to have the ability to direct the synthesis to steviol glycoside compositions of choice. Recombinant hosts described herein can produce compositions that are selectively enriched for specific steviol glycosides (e.g., RebD or RebM) and have a consistent taste profile. As used herein, the term "enriched" is used to describe a steviol glycoside composition with an increased proportion of a particular steviol glycoside, compared to a steviol glycoside composition (extract) from a *stevia* plant. Thus, the recombinant hosts described herein can facilitate the production of compositions that are tailored to meet the sweetening profile desired for a given food product and that have a proportion of each steviol glycoside that is consistent from batch to batch. In some embodiments, hosts described herein do not produce or produce a reduced amount of undesired plant by-products found in *Stevia* extracts. Thus, steviol glycoside compositions produced by the recombinant hosts described herein are distinguishable from compositions derived from *Stevia* plants.

It will be appreciated that the amount of an individual steviol glycoside (e.g., RebA, RebB, RebD, or RebM) produced by the recombinant host cell disclosed herein can accumulate in the cell culture broth from about 1 to about 7,000 mg/L, e.g., about 1 to about 10 mg/L, about 3 to about 10 mg/L, about 5 to about 20 mg/L, about 10 to about 50 mg/L, about 10 to about 100 mg/L, about 25 to about 500 mg/L, about 100 to about 1,500 mg/L, or about 200 to about 1,000 mg/L, at least about 1,000 mg/L, at least about 1,200 mg/L, at least about at least 1,400 mg/L, at least about 1,600 mg/L, at least about 1,800 mg/L, at least about 2,800 mg/L, or at least about 7,000 mg/L. In some aspects, the amount of an individual steviol glycoside produced by the recombinant host cell disclosed herein can exceed 7,000 mg/L in the cell culture broth.

It will be appreciated that the amount of a combination of steviol glycosides (e.g., RebA, RebB, RebD, or RebM) produced by the recombinant host cell disclosed herein can accumulate in the cell culture broth from about 1 mg/L to about 7,000 mg/L, e.g., about 200 to about 1,500, at least about 2,000 mg/L, at least about 3,000 mg/L, at least about 4,000 mg/L, at least about 5,000 mg/L, at least about 6,000 mg/L, or at least about 7,000 mg/L. In some aspects, the amount of a combination of steviol glycosides produced by the recombinant host cell disclosed herein can exceed 7,000 mg/L. In general, longer culture times will lead to greater amounts of product. Thus, the recombinant microorganism can be cultured for from 1 day to 7 days, from 1 day to 5 days, from 3 days to 5 days, about 3 days, about 4 days, or about 5 days.

It will be appreciated that the various genes and modules discussed herein can be present in two or more recombinant microorganisms rather than a single microorganism. When a plurality of recombinant microorganisms is used, they can be grown in a mixed culture to produce steviol and/or steviol glycosides. For example, a first microorganism can comprise one or more biosynthesis genes for producing a steviol glycoside precursor, while a second microorganism comprises steviol glycoside biosynthesis genes. The product produced by the second, or final microorganism is then recovered. It will also be appreciated that in some embodiments, a recombinant microorganism is grown using nutrient sources other than a culture medium and utilizing a system other than a fermenter.

Alternatively, the two or more microorganisms each can be grown in a separate culture medium and the product of the first culture medium, e.g., steviol, can be introduced into second culture medium to be converted into a subsequent intermediate, or into an end product such as RebA. The product produced by the second, or final microorganism is then recovered. It will also be appreciated that in some embodiments, a recombinant microorganism is grown using nutrient sources other than a culture medium and utilizing a system other than a fermenter.

Steviol glycosides and compositions obtained by the methods disclosed herein can be used to make food products, dietary supplements and sweetener compositions. See, e.g., WO 2011/153378, WO 2013/022989, WO 2014/122227, and WO 2014/122328.

For example, substantially pure steviol or steviol glycoside such as RebM or RebD can be included in food products such as ice cream, carbonated beverages, fruit juices, yogurts, baked goods, chewing gums, hard and soft candies, and sauces. Substantially pure steviol or steviol glycoside can also be included in non-food products such as pharmaceutical products, medicinal products, dietary supplements and nutritional supplements. Substantially pure steviol or steviol glycosides may also be included in animal feed products for both the agriculture industry and the companion animal industry. Alternatively, a mixture of steviol and/or steviol glycosides can be made by culturing recombinant microorganisms separately, each producing a specific steviol or steviol glycoside, recovering the steviol or steviol glycoside in substantially pure form from each microorganism and then combining the compounds to obtain a mixture comprising each compound in the desired proportion. The recombinant microorganisms described herein permit more precise and consistent mixtures to be obtained compared to current *Stevia* products.

In another alternative, a substantially pure steviol or steviol glycoside can be incorporated into a food product along with other sweeteners, e.g. saccharin, dextrose, sucrose, fructose, erythritol, aspartame, sucralose, monatin, or acesulfame potassium. The weight ratio of steviol or steviol glycoside relative to other sweeteners can be varied as desired to achieve a satisfactory taste in the final food product. See, e.g., U.S. 2007/0128311. In some embodiments, the steviol or steviol glycoside may be provided with a flavor (e.g., citrus) as a flavor modulator.

Compositions produced by a recombinant microorganism described herein can be incorporated into food products. For example, a steviol glycoside composition produced by a recombinant microorganism can be incorporated into a food product in an amount ranging from about 20 mg steviol glycoside/kg food product to about 1800 mg steviol glycoside/kg food product on a dry weight basis, depending on the type of steviol glycoside and food product. For example, a steviol glycoside composition produced by a recombinant microorganism can be incorporated into a dessert, cold confectionary (e.g., ice cream), dairy product (e.g., yogurt), or beverage (e.g., a carbonated beverage) such that the food product has a maximum of 500 mg steviol glycoside/kg food on a dry weight basis. A steviol glycoside composition produced by a recombinant microorganism can be incorporated into a baked good (e.g., a biscuit) such that the food product has a maximum of 300 mg steviol glycoside/kg food on a dry weight basis. A steviol glycoside composition produced by a recombinant microorganism can be incorporated into a sauce (e.g., chocolate syrup) or vegetable product (e.g., pickles) such that the food product has a maximum of 1000 mg steviol glycoside/kg food on a dry weight basis. A steviol glycoside composition produced by a recombinant microorganism can be incorporated into bread such that the food product has a maximum of 160 mg steviol glycoside/kg food on a dry weight basis. A steviol glycoside composition produced by a recombinant microorganism, plant, or plant cell can be incorporated into a hard or soft candy such that the food product has a maximum of 1600 mg steviol glycoside/kg food on a dry weight basis. A steviol glycoside composition produced by a recombinant microorganism, plant, or plant cell can be incorporated into a processed fruit product (e.g., fruit juices, fruit filling, jams, and jellies) such that the food product has a maximum of 1000 mg steviol glycoside/kg food on a dry weight basis. In some embodiments, a steviol glycoside composition produced herein is a component of a pharmaceutical composition. See, e.g., Steviol Glycosides Chemical and Technical Assessment 69th JECFA, 2007, prepared by Harriet Wallin, Food Agric. Org.; EFSA Panel on Food Additives and Nutrient Sources added to Food (ANS), "Scientific Opinion on the safety of steviol glycosides for the proposed uses as a food additive," 2010, *EFSA Journal* 8(4):1537; U.S. Food and Drug Administration GRAS Notice 323; U.S Food and Drug Administration GRAS Notice Notice 329; WO 2011/037959; WO 2010/146463; WO 2011/046423; and WO 2011/056834.

For example, such a steviol glycoside composition can have from 90-99 weight % RebA and an undetectable amount of *stevia* plant-derived contaminants, and be incorporated into a food product at from 25-1600 mg/kg, e.g., 100-500 mg/kg, 25-100 mg/kg, 250-1000 mg/kg, 50-500 mg/kg or 500-1000 mg/kg on a dry weight basis.

Such a steviol glycoside composition can be a RebB-enriched composition having greater than 3 weight % RebB and be incorporated into the food product such that the amount of RebB in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebB-enriched composition has an undetectable amount of *stevia* plant-derived contaminants.

Such a steviol glycoside composition can be a RebD-enriched composition having greater than 3 weight % RebD and be incorporated into the food product such that the amount of RebD in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebD-enriched composition has an undetectable amount of stevia plant-derived contaminants.

Such a steviol glycoside composition can be a RebE-enriched composition having greater than 3 weight % RebE and be incorporated into the food product such that the amount of RebE in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebE-enriched composition has an undetectable amount of stevia plant-derived contaminants.

Such a steviol glycoside composition can be a RebM-enriched composition having greater than 3 weight % RebM and be incorporated into the food product such that the amount of RebM in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebM-enriched composition has an undetectable amount of stevia plant-derived contaminants.

In some embodiments, a substantially pure steviol or steviol glycoside is incorporated into a tabletop sweetener or "cup-for-cup" product. Such products typically are diluted to the appropriate sweetness level with one or more bulking agents, e.g., maltodextrins, known to those skilled in the art. Steviol glycosides compositions enriched for RebA, RebB, RebD, RebE, or RebM, can be package in a sachet, for example, at from 10,000 to 30,000 mg steviol glycoside/kg product on a dry weight basis, for tabletop use. In some embodiments, a steviol glycoside produced in vitro, in vivo, or by whole cell bioconversion The invention will be further described in the following examples, which do not limit the scope of the invention described in the claims.

Examples

The Examples that follow are illustrative of specific embodiments of the invention, and various uses thereof. They are set forth for explanatory purposes only, and are not to be taken as limiting the invention.

Example 1: LC-MS Analytical Procedures

LC-MS analyses for Examples 3 and 4 were performed using an Agilent 1200 Series HPLC system (Agilent Technologies) fitted with a Phenomenex® Kinetex C18 column (150×2.1 mm, 2.6 µm particles, 100 Å pore size) connected to a TSQ Quantum Access (ThermoFisher Scientific) triple quadrupole mass spectrometer with a heated electrospray ion (HESI) source. Elution was carried out using a mobile phase of eluent B (MeCN with 0.1% Formic acid) and eluent A (water with 0.1% Formic acid) by increasing the gradient from 10-40% B from min 0.0 to 1.0, increasing 40-50% B in min 1.0 to 6.5, and increasing 50-100% B from min 6.5 to 7.0. The flow rate was 0.4 mL/min, and the column temperature was 30° C. 1,2-stevioside and RebD were detected using SIM (Single Ion Monitoring) in positive mode.

LC-MS analyses for Examples 8 and 9 were performed on Waters ACQUITY UPLC® (Waters Corporation) with a Waters ACQUITY UPLC® BEH C18 column (2.1×50 mm, 1.7 µm particles, 130 Å pore size) equipped with a pre-column (2.1×5 mm, 1.7 µm particles, 130 Å pore size) coupled to a Waters ACQUITY TQD triple quadrupole mass spectrometer with electrospray ionization (ESI) operated in negative ionization mode. Compound separation was achieved using a gradient of the two mobile phases: A (water with 0.1% formic acid) and B (MeCN with 0.1% formic acid) by increasing from 20% to 50% B between 0.3 to 2.0 min, increasing to 100% B at 2.01 min, holding 100% B for 0.6 min, and re-equilibrating for 0.6 min. The flow rate was 0.6 mL/min, and the column temperature was set at 55° C. Steviol glycosides were monitored using SIM (Single Ion Monitoring) and quantified by comparing against authentic standards. See Table 1 for m/z trace and retention time values of steviol glycosides detected.

TABLE 1

| LC-MS Analytical Data for Steviol and Steviol Glycosides | | | | |
|---|---|---|---|---|
| Compound | MS Trace | RT (min) | FIG.(s) | Table(s) |
| steviol + 5Glc (#22) [also referred to as compound 5.22] | 1127.48 | 0.85 | 6D, 7E, 8AK-8AN, 10A, 10B, 11D | 9C, 9F, 9I |
| steviol + 6Glc (isomer 1) [also referred to as compound 6.1] | 1289.53 | 0.87 | 6D, 7B, 8M-8P, 10A, 10B, 11D | 9C, 9F, 9I |
| steviol + 7Glc (isomer 2) [also referred to as compound 7.2] | 1451.581 | 0.94 | 6D, 7B, 8Q-8T, 11D | 9C, 9F, 9I |
| steviol + 6Glc (#23) [also referred to as compound 6.23] | 1289.53 | 0.97 | 6D, 10A, 10B, 11D | 9F, 9I |
| RebE | 965.42 | 1.06 | 6B, 6C, 10C, 11E | 9A, 9D, 9G |
| RebD | 1127.48 | 1.08 | 6A, 6C, 10C, 11E | 2, 3, 5, 9A, 9D, 9G |
| RebM | 1289.53 | 1.15 | 6A, 6C, 10C, 11E | 9A, 9D, 9G |
| steviol + 7Glc (isomer 5) [also referred to as compound 7.5] | 1451.581 | 1.09 | 7C, 8Y-8AB, 11D | 9F, 9I |
| steviol + 7Glc (#13) [also referred to as compound 7.13] | 1451.581 | 0.94 | 6D | |
| steviol + 4Glc (#26) [also referred to as compound 4.26] | 965.42 | 1.21 | 6D, 7D, 8AG-8AJ, 10A, 10B, 11D | 9C, 9F, 9H |
| steviol + 4Glc (#33) [also referred to as compound 4.33] | 965.42 | 1.49 | | 9C, 9I |
| steviol + 5Glc (#24) [also referred to as compound 5.24] | 1127.48 | 1.18 | 6D, 10A, 10B, 11D | 9F, 9I |
| steviol + 4Glc (#25) [also referred to as compound 5.25] | 1127.48 | 1.40 | 6D, 10A, 10B, 11D | 5, 9C, 9F, 9I |
| RebA | 965.42 | 1.43 | 6A, 6C, 10C, 11E | 9A, 9D, 9G |
| RebI | 1127.48 | 1.4 | | 9H |
| 1,2-stevioside | 803.37 | 1.43 | 10B, 11D | 2, 3, 5, 9B, 9E, 9H |
| steviol + 3Glc (#1) [also referred to as compound 3.1] | 803.37 | 1.52 | 6D, 10A, 10B, 11D | 9B, 9E |
| steviol + 2Glc (#23) [also referred to as compound 2.23] | 641.32 | 1.57 | 4C | |
| steviol + 3Glc (#34) [also referred to as compound 3.34] | 803.37 | | 4C | 9C, 9E |
| RebQ | 965.42 | 1.59 | | |
| 1,3-stevioside (RebG) | 803.37 | 1.60 | 6B-6D, 10B, 11E | 9D, 9G |
| rubusoside | 641.32 | 1.67 | 5, 6B, 6C, 10C, 11E | 5, 8B, 8C, 9D, 9G |

TABLE 1-continued

LC-MS Analytical Data for Steviol and Steviol Glycosides

| Compound | MS Trace | RT (min) | FIG.(s) | Table(s) |
|---|---|---|---|---|
| RebB | 803.37 | 1.76 | 6A, 6C, 10C, 11E | 9A, 9D, 9G |
| 1,2-bioside | 641.32 | 1.80 | 6B-D, 10C, 11D, 11E | 9A, 9D, 9G |
| 1,3-bioside | 641.32 | 1.95 | | 9E |
| 13-SMG | 479.26 | 2.04 | 4B, 6A, 6C, 10C, 11E | 8A, 8B, 8C, 9A, 9D, 9G |
| 19-SMG | 525.27 | 1.98 | 4B | 7A, 7B, 7C, 8B, 8C, 9E, 9H |
| ent-kaurenoic acid + 3Glc (isomer 1) [also referred to as compound KA3.1] | 787.37 | 2.16 | 4A, 7A, 8A-8C, 9A, 11A, 11B | 9B, 9E, 9H |
| ent-kaurenoic acid + 3Glc (isomer 2) [also referred to as compound KA3.2] | 787.37 | 2.28 | 4A, 7A, 8D-8F, 9A, 11A, 11B | 9B, 9E, 9H |
| ent-kaurenol + 3Glc (isomer 1) co-eluted with ent-kaurenol + 3Glc (#6) [also referred to as compounds KL3.1 and KL3.6] | 773.4 | 2.36 | 4A, 7A, 8J-8L, 9B, 11A, 11C | |
| ent-kaurenoic acid + 2Glc (#7) [also referred to as compound KA2.7] | 625.32 | 2.35 | 4A, 9A, 11A, 11B | 9B, 9D, 9H |
| ent-kaurenol + 2Glc (#8) [also referred to as compound KL2.8] | 611.34 | 2.38 | 9B, 7B, 11A, 11C | 9B, 9E |
| Steviol | 317.21 | 2.39 | 4C | 7A, 7B, 7C, 8A, 8B, 8C, 9F |

Steviol glycosides, including GlcNAc-derivatives, glycosylated ent-kaurenol, and/or glycosylated ent-kaurenoic acid can be isolated using a method described herein. For example, following fermentation, a culture broth can be centrifuged for 30 min at 7000 rpm at 4° C. to remove cells, or cells can be removed by filtration. The cell-free lysate can be obtained, for example, by mechanical disruption or enzymatic disruption of the host cells and additional centrifugation to remove cell debris. Mechanical disruption of the dried broth materials can also be performed, such as by sonication. The dissolved or suspended broth materials can be filtered using a micron or sub-micron prior to further purification, such as by preparative chromatography. The fermentation media or cell-free lysate can optionally be treated to remove low molecular weight compounds such as salt; and can optionally be dried prior to purification and re-dissolved in a mixture of water and solvent. The supernatant or cell-free lysate can be purified as follows: a column can be filled with, for example, HP20 Diaion® resin (Supelco) or other suitable non-polar adsorbent or reverse phase chromatography resin, and an aliquot of supernatant or cell-free lysate can be loaded on to the column and washed with water to remove the hydrophilic components. The steviol glycoside product can be eluted by stepwise incremental increases in the solvent concentration in water or a gradient from, e. g., 0%→100% methanol). The levels of steviol glycosides, glycosylated ent-kaurenol, and/or glycosylated ent-kaurenoic acid in each fraction, including the flow-through, can then be analyzed by LC-MS. Fractions can then be combined and reduced in volume using a vacuum evaporator. Additional purification steps can be utilized, if desired, such as additional chromatography steps and crystallization.

Example 2: Strain Engineering and Fermentation

Steviol glycoside-producing *S. cerevisiae* strains were constructed as described in WO 2011/153378, WO 2013/022989, WO 2014/122227, and WO 2014/122328, each of which is incorporated by reference in their entirety. For example, a yeast strain comprising one or more copies of a recombinant gene encoding a *Synechococcus* sp. GGPPS polypeptide (SEQ ID NO:19, SEQ ID NO:20), a recombinant gene encoding a truncated *Z. mays* CDPS polypeptide (SEQ ID NO:39, SEQ ID NO:40), a recombinant gene encoding an *A. thaliana* KS polypeptide (SEQ ID NO:51, SEQ ID NO:52), a recombinant gene encoding a recombinant *S. rebaudiana* KO polypeptide (SEQ ID NO:59, SEQ ID NO:60), a recombinant gene encoding an *A. thaliana* ATR2 polypeptide (SEQ ID NO:91, SEQ ID NO:92), a recombinant gene encoding an *O. sativa* EUGT11 polypeptide (SEQ ID NO:14/SEQ ID NO:15, SEQ ID NO:16), a recombinant gene encoding an SrKAHe1 polypeptide (SEQ ID NO:93, SEQ ID NO:94), a recombinant gene encoding an *S. rebaudiana* CPR8 polypeptide (SEQ ID NO:85, SEQ ID NO:86), a recombinant gene encoding an *S. rebaudiana* UGT85C2 polypeptide (SEQ ID NO:5/SEQ ID NO:6, SEQ ID NO:7) or a UGT85C2 variant (or functional homolog) of SEQ ID NO:7, a recombinant gene encoding an *S. rebaudiana* UGT74G1 polypeptide (SEQ ID NO:3, SEQ ID NO:4) or a UGT74G1 variant (or functional homolog) of SEQ ID NO:4, a recombinant gene encoding an *S. rebaudiana* UGT76G1 polypeptide (SEQ ID NO:8, SEQ ID NO:9) or a UGT76G1 variant (or functional homolog) of SEQ ID NO:9, and a recombinant gene encoding an *S. rebaudiana* UGT91D2e polypeptide (SEQ ID NO:10, SEQ ID NO:11) or a UGT91D2e variant (or functional homolog) of SEQ ID NO:11 such as a UGT91D2e-b (SEQ ID NO:12, SEQ ID NO:13) polypeptide produced steviol glycosides.

Example 3: Modulation of Substrate-Specificity of UGT91D2e

UGT91D1 (GenBank Accession No. AY345980) is highly expressed in the *Stevia* plant and thought to be a functional UGT. However, its substrate is not a steviol glycoside. This suggests that UGT91D1 has a different substrate than UGT91D2e, which may be defined by the 22 amino acids with which it differs from UGT91D2e. A UGT91D2e site saturation library (SSL) screen of the 22 amino acids differing from UGT91D1 was prepared using Geneart® (Life Technologies) and degenerate NNK-primers.

UGT91D2 SSL clones were expressed in *E. coli* XJb (DE3) Autolysis™ cells (Zymo Research). Colonies were grown overnight in 96 deep-well plates at 37° C. with 1 mL NZCYM (pH 7.0) comprising 15 g Tryptone, 7.5 g NaCl, 7.5 g yeast extract, 1.5 g casamino acids, 3 g $MgSO_4$ and fortified with 100 mg/L ampicillin and 33 mg/L chloramphenicol. 150 μL overnight cultures were transferred to 24 deep-well plates comprising 3 mL NZCYM with ampicillin, 0.1 mM isopropyl-β-D-1-thiogalactopyranoside (IPTG), 3 mM L-arabinose, and 2% (v/v) ethanol and incubated 20 h at 20° C. Cells were pelleted and lysed in 100 μL lysis buffer (10 mM Tris-HCl pH 8.0, 5 mM $MgCl_2$, 1 mM $CaCl_2$, 3 tablets/100 mL Complete mini protease inhibitor cocktail (Roche)) by a single freeze-thaw cycle and 50 μL DNase mix (1 μL 1.4 mg/mL deoxyribonuclease (Calbiochem), 1.2 μL 500 mM MgCl$_2$, and 47.8 μL of 4×PBS buffer). Plates were shaken at 500 rpm for 5 min at 25° C. to allow degradation of genomic DNA. Plates were then spun down at 4000 rpm for 30 min at 4° C. See WO 2013/022989, which is incorporated by reference in its entirety.

Activity of UGT91D2e variants was tested in vitro to assess the specificity of the UGT91D2e variants towards the substrates, rubusoside and RebA. 6 μL of the lysates were diluted with 24 μL of reaction mixture (final concentration: 100 mM Tris-HCl (pH 8.0), 5 mM MgCl$_2$, 1 mM KCl, 300 μM uridine diphosphate glucose (UDPG), and 100 μM rubusoside or RebA). The reaction mixture was incubated at 30° C. for 24 h, and 1,2-stevioside and RebD production was measured by LC-MS. Results are shown in Table 2.

TABLE 2

Activity of UGT91D2e-b and UGT91D2e variants on rubusoside and RebA, producing 1,2-stevioside and RebD, respectively.

| | 1,2-stevioside (μM) | RebD (μM) | 1,2-stevioside/RebD |
|---|---|---|---|
| UGT91D2e-b (SEQ ID NO: 13) | 264.9 | 2.7 | 98.1 |
| UGT91D2e V286C (SEQ ID NO: 1) | 59.3 | 0.0 | N/A (No activity on RebA) |
| UGT91D2e G384W (SEQ ID NO: 2) | 205.6 | 0.0 | N/A (No activity on RebA) |
| UGT91D2e L211M (SEQ ID NO: 118) | 129.7 | 3.7 | 35.1 |
| UGT91D2e L195G (SEQ ID NO: 119) | 178.4 | 0.9 | 198.2 |
| UGT91D2e V196P (SEQ ID NO: 120) | 162.1 | 2.4 | 67.5 |
| UGT91D2e L211H (SEQ ID NO: 121) | 123.5 | 5.1 | 24.2 |

As shown in Table 2, rubusoside and RebA were substrates of UGT91D2e-b (SEQ ID NO:13), UGT91D2e L211M (SEQ ID NO:118), UGT91D2e L195G (SEQ ID NO:119), UGT91D2e V196P (SEQ ID NO:120), and UGT91D2e L211H (SEQ ID NO:121), as 1,2-stevioside and RebD were produced upon contact of the enzymes with either rubusoside or RebA. However, the ratio of 1,2-stevioside/RebD produced by UGT91D2e-b (SEQ ID NO:13), UGT91D2e L211M (SEQ ID NO:118), UGT91D2e L195G (SEQ ID NO:119), UGT91D2e V196P (SEQ ID NO:120), and UGT91D2e L211H (SEQ ID NO:121) fluctuated from 24.2 to 198.2, indicating that the enzymes were not equally selective towards either substrate. The UGT91D2e V286C and UGT91D2e G384W variants were selective towards rubusoside; no RebD was produced upon contact of either variant with RebA.

Additional variants of UGT91D2e were found to demonstrate substrate specificity towards rubusoside or RebA using the above-described assay. See Table 3. The variants of SEQ ID NO:200 (P93V M152G), SEQ ID NO:201 (S99I), SEQ ID NO:203 (T144L), SEQ ID NO:205 (A148K L211I), SEQ ID NO:212 (G384K) were selective towards RebA. The UGT91D2e variants of SEQ ID NO:197 (L195V), SEQ ID NO:198 (V286S), SEQ ID NO:202 (T144K P201P (silent)), SEQ ID NO:209 (L211T I130I (silent)), SEQ ID NO:211 (S114F V286S), SEQ ID NO:214 (E438M) were selective towards rubusoside.

TABLE 3

Activity of UGT91D2e variants on rubusoside and RebA, producing 1,2-stevioside and RebD, respectively.

| Variant | 1,2-stevioside (μM) | RebD (μM) | 1,2-stevioside/RebD |
|---|---|---|---|
| UGT91D2e L213E (SEQ ID NO: 191) | 13.6 | 1.1 | 12.4 |
| UGT91D2e S221Y (SEQ ID NO: 192) | 13.1 | 27.1 | 0.5 |
| UGT91D2e E438H (SEQ ID NO: 193) | 5.1 | 1.4 | 3.6 |
| UGT91D2e M152T (SEQ ID NO: 194) | 16.8 | 1.5 | 11.2 |
| UGT91D2e L211C (SEQ ID NO: 195) | 7.3 | 1.6 | 15.8 |
| UGT91D2e L195S (SEQ ID NO: 196) | 16.4 | 1.4 | 11.7 |
| UGT91D2e L195V (SEQ ID NO: 197) | 35.9 | 0.0 | N/A (No activity on RebA) |
| UGT91D2e V286S (SEQ ID NO: 198) | 14.2 | 0.0 | N/A (No activity on RebA) |
| UGT91D2e S221S (silent) (SEQ ID NO: 199) | 16.2 | 1.7 | 9.5 |
| UGT91D2e P93V M152G (SEQ ID NO: 200) | 0.2 | 2.5 | 0.1 |
| UGT91D2e S99I (SEQ ID NO: 201) | 0.2 | 2.6 | 0.1 |
| UGT91D2e T144K P201P (silent) (SEQ ID NO: 202) | 1.6 | 0.0 | N/A (No activity on RebA) |
| UGT91D2e T144L (SEQ ID NO: 203) | 0.0 | 2.6 | 0.0 (No activity on rubusoside) |
| UGT91D2e T144M (SEQ ID NO: 204) | 1.3 | 1.6 | 0.8 |
| UGT91D2e A148K L211I (SEQ ID NO: 205) | 0.2 | 2.7 | 0.1 |
| UGT91D2e L195N (SEQ ID NO: 206) | 5.1 | 1.0 | 5.1 |
| UGT91D2e K199C (SEQ ID NO: 207) | 2.6 | 1.3 | 2.0 |
| UGT91D2e L211M E426G A466V (SEQ ID NO: 208) | 79.1 | 1.1 | 71.9 |
| UGT91D2e L211T I303I (silent) (SEQ ID NO: 209) | 2.7 | 0.0 | N/A (No activity on RebA) |
| UGT91D2e V286N (SEQ ID NO: 210) | 3.0 | 0.0 | N/A (No activity on RebA) |
| UGT91D2e S114F V286S (SEQ ID NO: 211) | 5.9 | 0.0 | N/A (No activity on RebA) |
| UGT91D2e G384K (SEQ ID NO: 212) | 0.0 | 2.2 | 0.0 (No activity on rubusoside) |
| UGT91D2e G384Y (SEQ ID NO: 213) | 2.9 | 1.9 | 1.5 |
| UGT91D2e E438M (SEQ ID NO: 214) | 4.7 | 0.0 | N/A (No activity on RebA) |
| UGT91D2e L195C (SEQ ID NO: 123) | 3.2 | 1.3 | 2.5 |

Example 4: Evaluation of UGT91D2e-b-EUGT11 Chimeric Enzymes

UGT91D2e-b-EUGT11 chimeric enzymes were tested in vitro to access activity on the substrates, rubusoside and RebA. UGT91D2e-b-EUGT11 chimeras were created by polymerase chain reaction (PCR)-amplification and overlap extension PCR using the primers in Table 4.

TABLE 4

Primers Used to Create UGT91D2e-b-EUGT11 Chimeric Enzymes.

| Description | Sequence | SEQ ID |
|---|---|---|
| Vector (forward) | GGCAAGCCACGTTTGGTG | SEQ ID NO: 135 |
| Vector (reverse) | GGAGCTGCATGTGTCAGAGG | SEQ ID NO: 136 |
| EUGT11 fragment 1/UGT91D2e-b fragment 2 (forward) | CGATGTATTTCATCACTGGTTGCC ATCCATCGCGGCT | SEQ ID NO: 137 |
| EUGT11/UGT91D2e-b fragment 2 (reverse) | AGCCGCGATGGATGGCAACCAGT GATGAAATACATCG | SEQ ID NO: 138 |
| UGT91D2e-b fragment 1/ EUGT11 fragment 2 (forward) | TTATGATTATACTCACTACTGGGC TGCTGCAGCCGCATTG | SEQ ID NO: 139 |
| UGT91D2e-b fragment 1/ EUGT11 fragment 2 (reverse) | AGCCGCGATGGATGGCAACCAGT GATGAAATACATCG | SEQ ID NO: 140 |
| EUGT11 fragment 2/UGT91D2e-b fragment 3 (forward) | CAAACCTATTACTTTCCTTGGTTT ACTGCCACCGGAAATAC | SEQ ID NO: 141 |
| EUGT11 fragment 2/UGT91D2e-b fragment 3 (reverse) | GTATTTCCGGTGGCAGTAAACCA AGGAAAGTAATAGGTTTG | SEQ ID NO: 142 |
| UGT91D2e-b fragment 2/ EUGT11 fragment 3 (forward) | CCGGTGGTTCCGGTGGGACTAAT GCCTCCATTACATGA | SEQ ID NO: 143 |
| UGT91D2e-b fragment 2/ EUGT11 fragment 3 (reverse) | TCATGTAATGGAGGCATTAGTCCC ACCGGAACCACCGG | SEQ ID NO: 144 |
| EUGT11 fragment 3/UGT91D2e-b fragment 4 (forward) | GAACGCAGGTCTGCAGGTTCCAA GAAATGAGGAAGATGG | SEQ ID NO: 145 |
| EUGT11 fragment 3/UGT91D2e-b fragment 4 (reverse) | CCATCTTCCTCATTTCTTGGAACC TGCAGACCTGCGTTC | SEQ ID NO: 146 |

UGT91D2e-b-EUGT11 chimeric enzymes were expressed in *E. coli* XJb(DE3) Autolysis™ cells (Zymo Research). Colonies were grown in 50 mL NZCYM (pH 7.0) with ampicillin and chloramphenicol and re-inoculated into 500 mL NZCYM with IPTG, L-arabinose, and ethanol. Cell lysate preparations were done in 15 mL lysis buffer followed by 150 μL DNase and 200 μL 500 mM $MgCl_2$. GST-tag affinity purification of the chimeras was performed by adding ⅓ volume of 4×PBS buffer (560 mM NaCl, 10.8 mM KCl, 40 mM $Na_2HPO_4$, 7.2 mM $KH_2PO_4$, pH 7.3)) to the lysate supernatant, followed by incubation (2 h, 4° C.) with Glutathione Sepharose 4B (GE Healthcare) and loading onto Poly-Prep® Chromatography Columns (Bio-Rad). The beads were washed twice with 1×PBS buffer and eluted with 50 mM Tris-HCl (pH 8.0) and 10 mM reduced glutathione. Eluted protein was stabilized by addition of glycerol to a final concentration of 50%. SDS-PAGE was performed using NuPAGE® 4-12% Bis-Tris 1.0 mm precast gels (Invitrogen), NuPAGE MOPS (Invitrogen) running buffer and SimplyBlue SafeStain (Invitrogen). The amounts of chimeras produced were determined from the relative staining intensity of the gel images using ImageJ software.

Chimeras were screened by adding 20 μL purified UGT91D2e-b, EUGT11, or UGT91D2e-b-EUGT11 chimeric enzymes (0.02 mg/mL) to a total volume of 80 μL reaction mixture comprising 100 mM Tris-HCl (pH 8.0), 5 mM $MgCl_2$, 1 mM KCl, 300 μM uridine diphosphate glucose (UDPG), and 100 μM rubusoside or RebA. The reactions were incubated at 30° C. for 24 h, and levels of RebA, RebD, rubusoside, and 1,2-stevioside were measured by LC-MS. Not all of the chimeras purified were active in the above described assay (see Table 5 for enzymes having activity on rubusoside and/or RebA).

TABLE 5

EUGT11, UGT91D2e-b, and EUGT11-UGT91D2e-b chimeric enzyme activity on RebA and rubusoside.

| | RebA (μM) | RebD (μM) | rubusoside (μM) | 1,2-stevioside (AUC) |
|---|---|---|---|---|
| EUGT11 (SEQ ID NO: 16) | 32.230 | 101.300 | 34.899 | 1188497 |
| UGT91D2e-b (SEQ ID NO: 13) | 97.314 | 6.580 | 41.157 | 2660570 |
| Chim_3 (SEQ ID NO: 17) | 109.764 | NF | 138.911 | 11435 |
| Chim_7 (SEQ ID NO: 18) | 88.502 | 11.510 | NF | 3693895 |

*NF = Not Found

As shown in Table 5, Chim_7 (SEQ ID NO:18) more efficiently converted rubusoside to 1,2-stevioside, compared to EUGT11 and UGT91D2e. Chim_7 (SEQ ID NO:18) fully consumed the supplied amount of rubusoside, unlike EUGT11 or UGT91D2e. When incubating EUGT11 with rubusoside, the C19-position of rubusoside was 1,2-glycosylated, and RebE and 1,2-stevioside were also produced (Table 5). Additionally, Chim_7 (SEQ ID NO:18) demonstrated 1.75-fold higher activity towards RebA than UGT91D2e-b. Chim_3 (SEQ ID NO:17) selectively converted rubusoside to 1,2-stevioside; no RebA was converted to RebD by Chim_3 (SEQ ID NO:17) (Table 5).

Example 5: Evaluation of UGT85C2 Variants

Three homology models of UGT85C2 were generated with the ORCHESTRA module in Sybyl-X 2.0 (Certara) using a combination of the three PDB templates (Model 1: 2PQ6, 2VCE, 2C1X; Model 2: 2PQ6; Model 3: 2PQ6, 2C1X) and using standard settings and sequences for UGT85H2, UGT72B1, and VvGT1 (see PDB2PQ6, PDB2VCE, and PCB2C1X). Model geometry and quality were checked with the molprobity and ProQ webservers (see Chen et al., Acta Crystallographica. Section D, Biological Crystallography 66(Pt 1):12-21 (2010), Davis et al., Nucleic Acids Research 35:W375-83 (2007), Wallner & Elofsson, Protein Science: A Publication of the Protein Society 12(5): 1073-86 (2003). The fluorinated UDPG sugar donor analog, UDP-2FGlc, from PDB:2VCE was imported into the UDPG binding site of UGT85C2 prior to the acceptors steviol, 13-SMG, 19-SMG, or rubusoside. Steviol and steviol glycosides were prepared using the Sybyl-X small molecule builder and docked into the active site of the enzyme with the Surflex Dock suite using standard GeomX settings. The sites for the site saturation library (SSL) were determined by selecting all the residues within 3 Å of the ligands in the docking analysis that were not 100% conserved in the PDB-templates. See Table 6.

TABLE 6

SSL residues for UGT85C2 Docking Analysis.

| | UGT85C2 Model #1 | UGT85C2 Model #2 | UGT85C2 Model #3 | Conserved |
|---|---|---|---|---|
| Phe18 | x | x | x | |
| Pro19 | x | x | x | C |
| Ala20 | x | x | x | |
| Gln21 | x | x | x | |
| Ser22 | x | x | x | |
| His23 | x | x | x | C |
| Lys25 | | x | x | |
| Phe48 | | x | x | |
| Ile49 | | | x | |
| Gln52 | | | x | |
| Glu82 | | x | | |
| Ala83 | | x | | |
| Ser84 | | x | | |
| Pro86 | | | x | |
| Ile87 | | | x | |
| Arg88 | x | | x | |
| Leu91 | x | | x | |
| Leu92 | x | | | |
| Ile95 | x | | | |
| Phe122 | x | | | |
| Thr143 | x | x | | |
| Leu144 | x | x | x | |
| Asp198 | | x | | |
| Val207 | | x | | |
| Phe210 | x | | | |
| Thr211 | x | | | |
| Asn300 | x | | | |
| Phe301 | x | | | C |
| Gly302 | x | | x | C |
| Ser303 | x | | x | |
| Thr304 | x | x | x | |
| Thr305 | x | x | x | |
| Val306 | | | x | |
| Leu334 | | | x | |
| Trp359 | | | x | C |
| Gln362 | x | | | |
| His377 | x | x | | C |
| Gly379 | | x | x | C |
| Trp380 | x | x | x | C |
| Gly381 | | x | x | |
| Ser382 | x | | | C |
| Tyr398 | | x | x | |
| Trp400 | x | x | x | |
| Asp401 | x | x | x | |
| Gln402 | x | x | | C | x: Residue within 3 Å of steviol, 19-SMG, and UDPG in the docking analysis
C: Conserved residue SSL clones were generated for the 34 non-conserved amino acids in Table 6 predicted to be within 3 Å of the ligands residues. A modified version of the whole plasmid amplification method (Zheng et al. Nucleic Acids Research 32(14):e115 (2004)) was used with overlapping NNK-primers and Phusion polymerase. 10 µL PCR reaction was treated with 10 U DpnI (New England Biolabs) at 37° C. for 1 h, heat inactivated at 65° C. for 20 min, and transformed into E. coli DH5a cells. Colonies were selected on Luria Broth (LB)+kanamycin agar plates and grown in 4 mL LB fortified with kanamycin. Plasmids were purified using the Gene-JET™ miniprep kit (Thermo Fisher Scientific) and sequenced.

The sequence-verified site saturation library (SSL) clones were transformed into E. coli XJb(DE3) Autolysis™ cells (Zymo Research) and selected on LB+kanamycin agar plates. Single colonies were inoculated into 1 mL NZCYM fortified with 30 mg/L kanamycin and incubated overnight at 37° C. and 200 rpm orbital shaking. 50 µL of the overnight culture were transferred into 1 mL of fresh NZCYM fortified with 30 mg/L kanamycin, 3 mM arabinose, and 0.1 mM IPTG and incubated overnight at 20° C. and 200 rpm orbital shaking. The cells were spun down at 3220 g/10 min at 4° C. and resuspended in 50 µL GT-buffer (10 mM Tris-HCl (pH 7.5), 5 mM $MgCl_2$, 1 mM $CaCl_2$) comprising complete Mini EDTA free protease inhibitor cocktail (1 tablet/25 mL GT-buffer; Roche Diagnostics). Pellets were resuspended by orbital shaking at 200 rpm/5 min at 4° C. Cells were incubated at −80° C. for minimum 15 min before initiation of lysing step.

The cells were lysed by heating the samples to 25° C. and adding 25 µL DNAse I mix comprising of 2.39 mL 4×His binding buffer (80 mM Tris-HCl (pH 7.5), 500 mM NaCl, 10 mM Imidazole) with 50 µL 1.4 mg/mL DNAse I bovine pancreas (Calbiochem) and 60 µL $MgCl_2$ (500 mM). The lysates were filtered through a 1.2 µm 96-well filterplate (EMD Millipore) and transferred to another 1.2 µm filterplate comprising 50 µL His-select beads (Sigma-Aldrich) prewashed twice with 1×binding buffer. The lysates and beads were then incubated for 2 h at 4° C. with 500 rpm orbital shaking. The plates were spun down at 450 g/2 min. Total protein concentration in the flow-through was measured using the Bradford assay reagent (Sigma-Aldrich), the samples were washed twice by centrifuging the samples, removing supernatants and adding 50 µL 1×His binding buffer. Elution buffer (20 mM Tris-HCl (pH 7.5), 500 mM NaCl, 250 mM imidazole) was added to the beads and incubated for 5 min at 4° C. at 500 rpm orbital shaking and the proteins eluted into a 96 well PCR plate (FrameStar 96, 4titude). The purifications were evaluated by running samples of the flow-through, washing steps and eluate on NuPAGE® SDS-PAGE gel system with 4-12% Bis-Tris precast gels (Invitrogen).

Activity of the purified UGT85C2 variants was measured. 2.0 µg/mL UGT85C2 variant was incubated for 20 min at 37° C. with reaction buffer (100 mM Tris-HCl (pH 8.0), 1 mM KCl, Calf Intestinal Alkaline Phosphatase (New England Biolabs), 120 µM UDPG, and either 40 µM steviol or 40 µM 19-SMG). In this assay, the glucose on UDPG was transferred to steviol or 19-SMG; the products were UDP and either 13-SMG or rubusoside. The phosphates on UDP were then released by a phosphatase, and the amount of phosphate released was measured at $Abs_{600}$ using the Malachite green protocol (Baykov et al., Analytical Biochemistry 171(2):266-70). Values were normalized by total protein released measured by using Bradford reagent (Sigma-Aldrich).

Candidates were selected as having activity of one standard deviation or higher than wild-type activity or having less than 50% activity on one substrate while maintaining wild-type activity on the other (e.g., exhibiting substrate-specificity). The $Abs_{600}$ ratios of a steviol sample to a 19-SMG sample for wild-type UGT85C2 (SEQ ID NO:7) averaged 0.94, indicating that the wild-type UGT85C2 catalyzes conversion of steviol and 19-SMG with little or no preference of substrate. Table 7A shows the UGT85C2 variants analyzed that preferentially catalyzed conversion of 19-SMG over conversion of steviol, Table 7B shows the UGT85C2 variants analyzed that preferentially catalyzed conversion of steviol over conversion of 19-SMG, and Table 7C shows the UGT85C2 variants analyzed that catalyzed conversion of 19-SMG and steviol with little preference for either substrate. Particular clones generated by the site saturation library (SSL) screen were selected more than once, corresponding to more than one entry in Tables 7A-C.

TABLE 7A

UGT85C2 SSL screen candidates that were selective towards 19-SMG as a substrate.

| Steviol (Abs$_{600}$) | 19-SMG (Abs$_{600}$) | Steviol/ 19-SMG Abs$_{600}$ Ratio | Sum (Abs$_{600}$) | Mutation | UGT85C2 Variant SEQ ID |
|---|---|---|---|---|---|
| 0.105 | 0.165 | 0.636 | 0.27 | F48S | SEQ ID NO: 150 |
| 0.099 | 0.136 | 0.728 | 0.235 | F48H | SEQ ID NO: 151 |
| 0.089 | 0.142 | 0.627 | 0.231 | F48Y | SEQ ID NO: 152 |
| 0.080 | 0.117 | 0.684 | 0.197 | F48R | SEQ ID NO: 153 |
| 0.068 | 0.126 | 0.540 | 0.194 | F48Q | SEQ ID NO: 154 |
| 0.068 | 0.112 | 0.607 | 0.18 | F48T | SEQ ID NO: 156 |
| 0.065 | 0.114 | 0.570 | 0.179 | F48S | SEQ ID NO: 150 |
| 0.094 | 0.141 | 0.667 | 0.235 | I49V | SEQ ID NO: 157 |
| 0.078 | 0.111 | 0.703 | 0.189 | I49V | SEQ ID NO: 157 |
| 0.116 | 0.238 | 0.487 | 0.354 | S84V | SEQ ID NO: 164 |
| −0.020 | 0.153 | 19-SMG | 0.133 | S84V | SEQ ID NO: 164 |
| 0.096 | 0.230 | 0.417 | 0.326 | P86R | SEQ ID NO: 165 |
| 0.083 | 0.196 | 0.423 | 0.279 | P86R | SEQ ID NO: 165 |
| 0.065 | 0.17 | 0.382 | 0.235 | P86R | SEQ ID NO: 165 |
| 0.042 | 0.18 | 0.233 | 0.222 | P86G | SEQ ID NO: 166 |
| −0.003 | 0.169 | 19-SMG | 0.166 | P86R | SEQ ID NO: 165 |

TABLE 7B

UGT85C2 SSL screen candidates that were selective towards steviol as a substrate.

| Steviol (Abs$_{600}$) | 19-SMG (Abs$_{600}$) | Steviol/ 19-SMG Ratio | Sum (Abs$_{600}$) | Mutation | UGT85C2 Variant SEQ ID |
|---|---|---|---|---|---|
| 0.382 | −0.081 | Steviol | 0.301 | S84T | SEQ ID NO: 160 |
| 0.242 | −0.083 | Steviol | 0.159 | S84T | SEQ ID NO: 160 |
| 0.521 | −0.033 | Steviol | 0.488 | I87M | SEQ ID NO: 169 |
| 0.261 | 0.190 | 1.374 | 0.451 | I87Y | SEQ ID NO: 170 |
| 0.372 | 0.159 | 2.340 | 0.531 | L91K | SEQ ID NO: 171 |
| 0.369 | 0.134 | 2.754 | 0.503 | L91K | SEQ ID NO: 171 |
| 0.228 | 0.104 | 2.192 | 0.332 | L91R | SEQ ID NO: 172 |
| 0.202 | 0.079 | 2.557 | 0.281 | L91R | SEQ ID NO: 172 |
| 0.147 | 0.041 | 3.585 | 0.188 | L91T | SEQ ID NO: 173 |
| 0.606 | 0.266 | 2.278 | 0.872 | I95K | SEQ ID NO: 177 |

TABLE 7C

UGT85C2 SSL screen candidates that were not substrate selective towards steviol or 19-SMG.

| Steviol (Abs$_{600}$) | 19-SMG (Abs$_{600}$) | Steviol/ 19-SMG Ratio | Sum (Abs$_{600}$) | Mutation | UGT85C2 Variant SEQ ID |
|---|---|---|---|---|---|
| 0.229 | 0.268 | 0.854 | 0.497 | Q21L | SEQ ID NO: 147 |
| 0.231 | 0.261 | 0.885 | 0.492 | Q21T | SEQ ID NO: 148 |
| 0.214 | 0.252 | 0.849 | 0.466 | Q21V | SEQ ID NO: 149 |
| 0.083 | 0.098 | 0.847 | 0.181 | F48W | SEQ ID NO: 155 |
| 0.359 | 0.332 | 1.081 | 0.691 | S84G | SEQ ID NO: 158 |
| 0.306 | 0.331 | 0.924 | 0.637 | S84A | SEQ ID NO: 159 |
| 0.296 | 0.292 | 1.014 | 0.588 | S84C | SEQ ID NO: 161 |
| 0.250 | 0.299 | 0.836 | 0.549 | S84P | SEQ ID NO: 162 |
| 0.250 | 0.256 | 0.977 | 0.506 | S84A | SEQ ID NO: 159 |

TABLE 7C-continued

UGT85C2 SSL screen candidates that were not substrate selective towards steviol or 19-SMG.

| Steviol (Abs$_{600}$) | 19-SMG (Abs$_{600}$) | Steviol/ 19-SMG Ratio | Sum (Abs$_{600}$) | Mutation | UGT85C2 Variant SEQ ID |
|---|---|---|---|---|---|
| 0.219 | 0.262 | 0.836 | 0.481 | S84N | SEQ ID NO: 163 |
| 0.355 | 0.306 | 1.160 | 0.661 | I87H | SEQ ID NO: 167 |
| 0.326 | 0.274 | 1.190 | 0.600 | I87P | SEQ ID NO: 168 |
| 0.308 | 0.282 | 1.092 | 0.590 | I87M | SEQ ID NO: 169 |
| 0.279 | 0.216 | 1.292 | 0.495 | I87Y | SEQ ID NO: 170 |
| 0.474 | 0.426 | 1.113 | 0.900 | L92F | SEQ ID NO: 174 |
| 0.387 | 0.331 | 1.169 | 0.718 | L92I | SEQ ID NO: 175 |
| 0.342 | 0.260 | 1.315 | 0.602 | L92M | SEQ ID NO: 176 |
| 0.39 | 0.598 | 0.652 | 0.988 | F122S | SEQ ID NO: 178 |
| 0.297 | 0.248 | 1.198 | 0.545 | L334S | SEQ ID NO: 179 |
| 0.27 | 0.233 | 1.159 | 0.503 | L334M | SEQ ID NO: 180 |

The purified S84V and P86R variants of UGT85C2 were selective towards 19-SMG; UGT85C2 S84V and UGT85C2 P86R did not demonstrate activity on steviol (Table 7A). The purified F48S, F48H, F48Y, F48R, F48Q, F48T, F48S, I49V, P86R, P86G, and F122S UGT85C2 variants also showed selectivity towards 19-SMG (Table 7A). However, the purified S84T and I87M variants of UGT85C2 were selective towards steviol; UGT85C2 S84T and UGT85C2 I87M did not demonstrate activity on 19-SMG (Table 7B). The purified I87P, I87Y, L91K, L91R, L91T, L92M, and I95K UGT85C2 variants also showed selectivity towards steviol (Table 7B).

Example 6: Characterization of Steviol Glycoside-Producing Yeast Strain Deleted of UGT85C2

A modified version of the steviol glycoside-producing *S. cerevisiae* strain described in Example 2, a recombinant KO gene encoded by the nucleotide sequence set forth in SEQ ID NO:67 (corresponding to the amino acid sequence set forth in SEQ ID NO:117) and a recombinant CPR1 gene encoding (SEQ ID NO:77, SEQ ID NO:78) was deleted for *S. rebaudiana* UGT85C2 polypeptide (SEQ ID NO:5/SEQ ID NO:6, SEQ ID NO:7). Sixteen independent clones were grown in Synthetic Complete (SC) medium at 30° C. for 5 days with shaking (400 rpm for deep wells) prior to harvest. Culture samples (without cell removal) were heated in the presence of DMSO for detection of total glycoside levels with LC-MS.

Figure 4B:
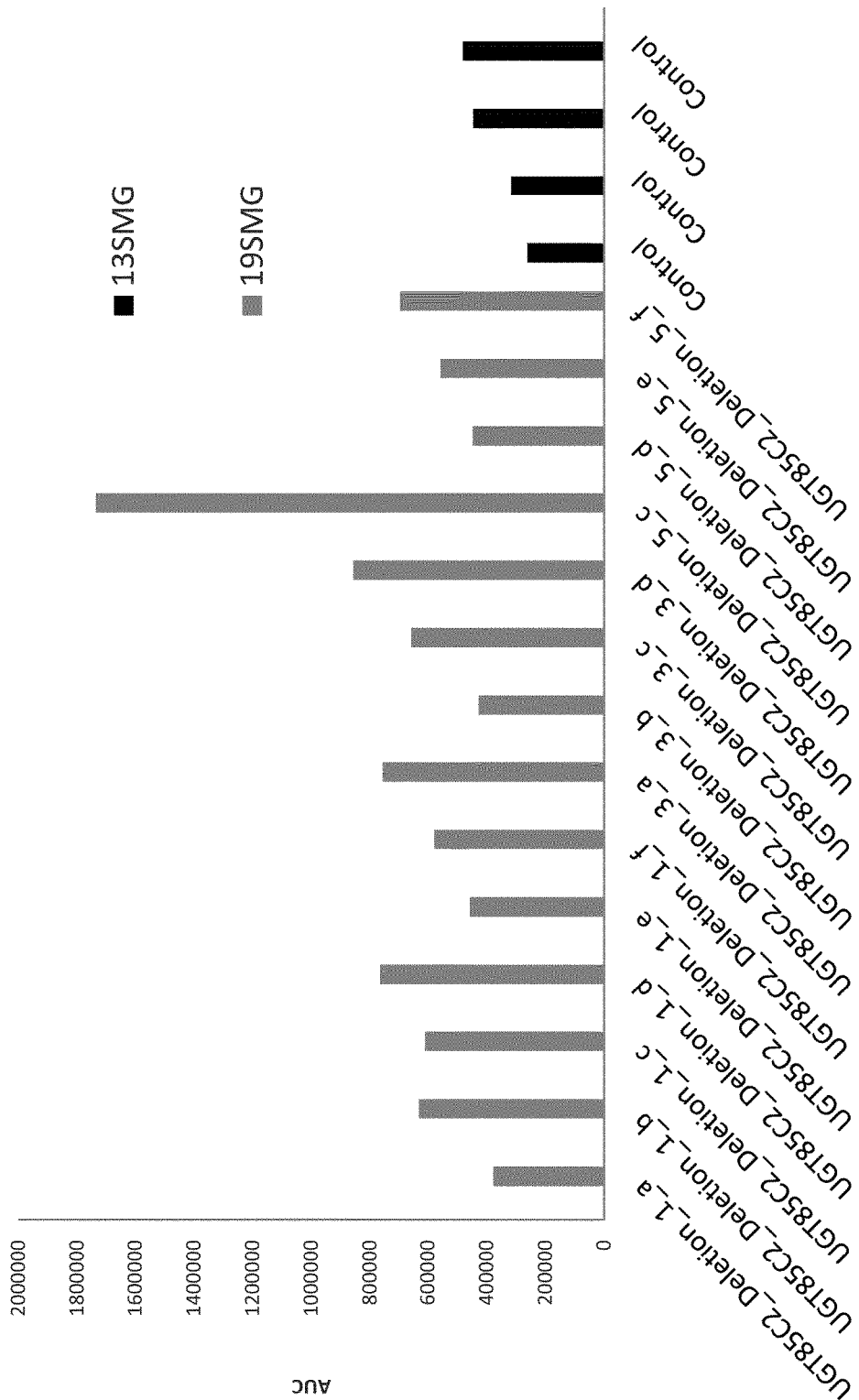
FIG. 4B shows accumulation of 19-SMG by a steviol glycoside-producing S. cerevisiae strain deleted of UGT85C2 (SEQ ID NO:7).
Figure 4C:
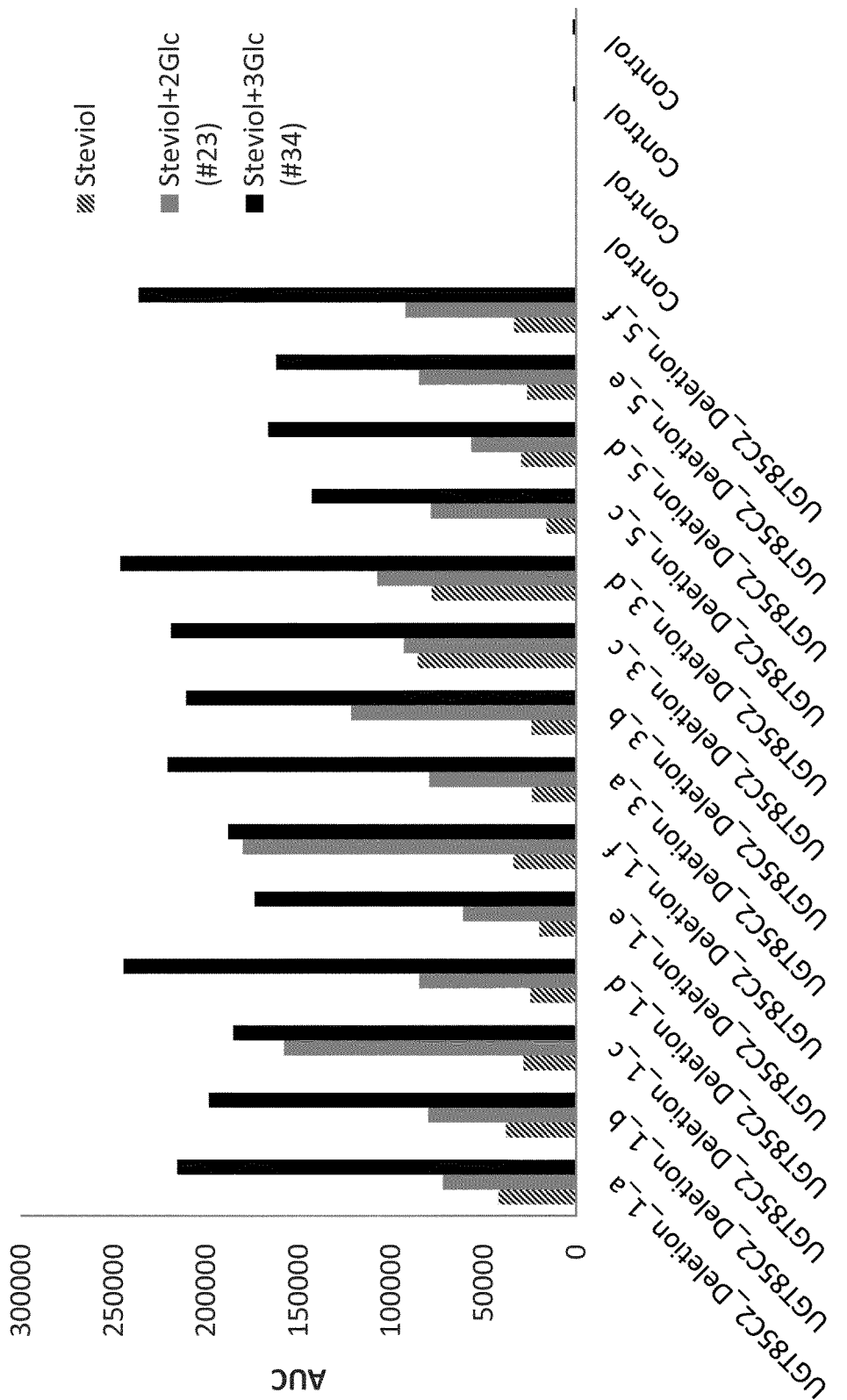
FIG. 4C shows accumulation of steviol, steviol+2Glc (#23), and steviol+3Glc (#34) by a steviol glycoside-producing S. cerevisiae strain deleted of UGT85C2 (SEQ ID NO:7). See Example 6.

As shown in FIG. 4A, culture samples of cells deleted of UGT85C2 did not accumulate ent-kaurenol glycosides (ent-kaurenol+3Glc (isomer 1), ent-kaurenol+3Glc (#6), or ent-kaurenol_2Glc (#8), as compared to the control strain (not deleted for UGT85C2). This result suggests that UGT85C2 is responsible for the 19-O-glucosylation of ent-kaurenol. Also as shown in FIG. 4A, culture samples of cells deleted of UGT85C2 did accumulate ent-kaurenoic acid glycosides (ent-kaurenoic acid+2Glc (#7), ent-kaurenoic acid+3Glc (isomer 1), and ent-kaurenoic acid+3Glc (isomer 2)). Whereas control samples accumulated 13-SMG, culture samples of cells deleted of UGT85C2 accumulated 19-SMG, steviol, steviol+2Glc (#23), and steviol+3Glc (#34). See FIGS. 4B and 4C. Steviol+2Glc (#23) and steviol+3Glc (#34) likely have two or three glucose moieties, respectively, attached on the 19 position of the steviol backbone.

Figure 7E:
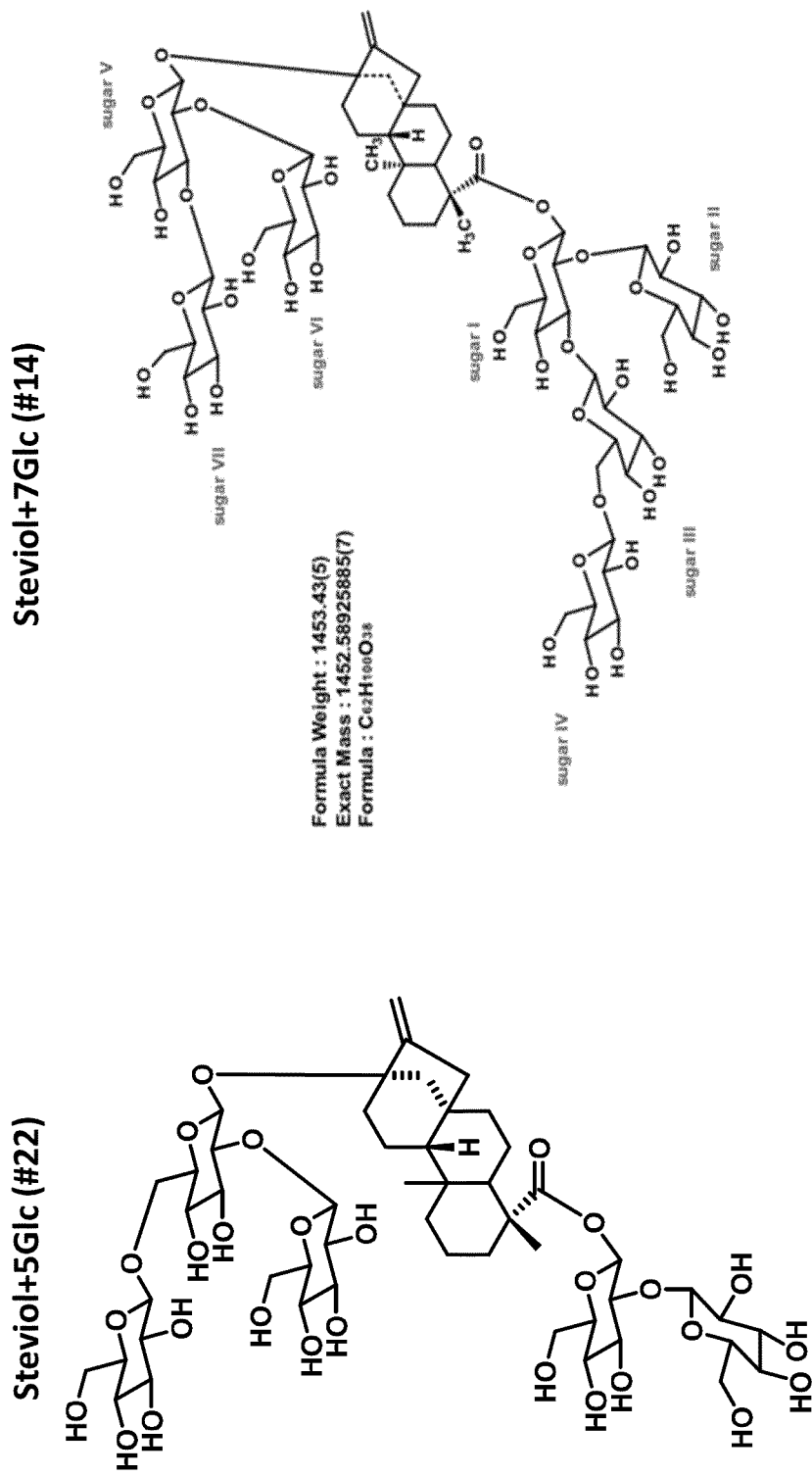
FIG. 7E shows NMR-elucidated structures of steviol+5Glc (#22) and steviol+7Glc (#14). See Examples 6, 8, and 9.
Figure 8A:
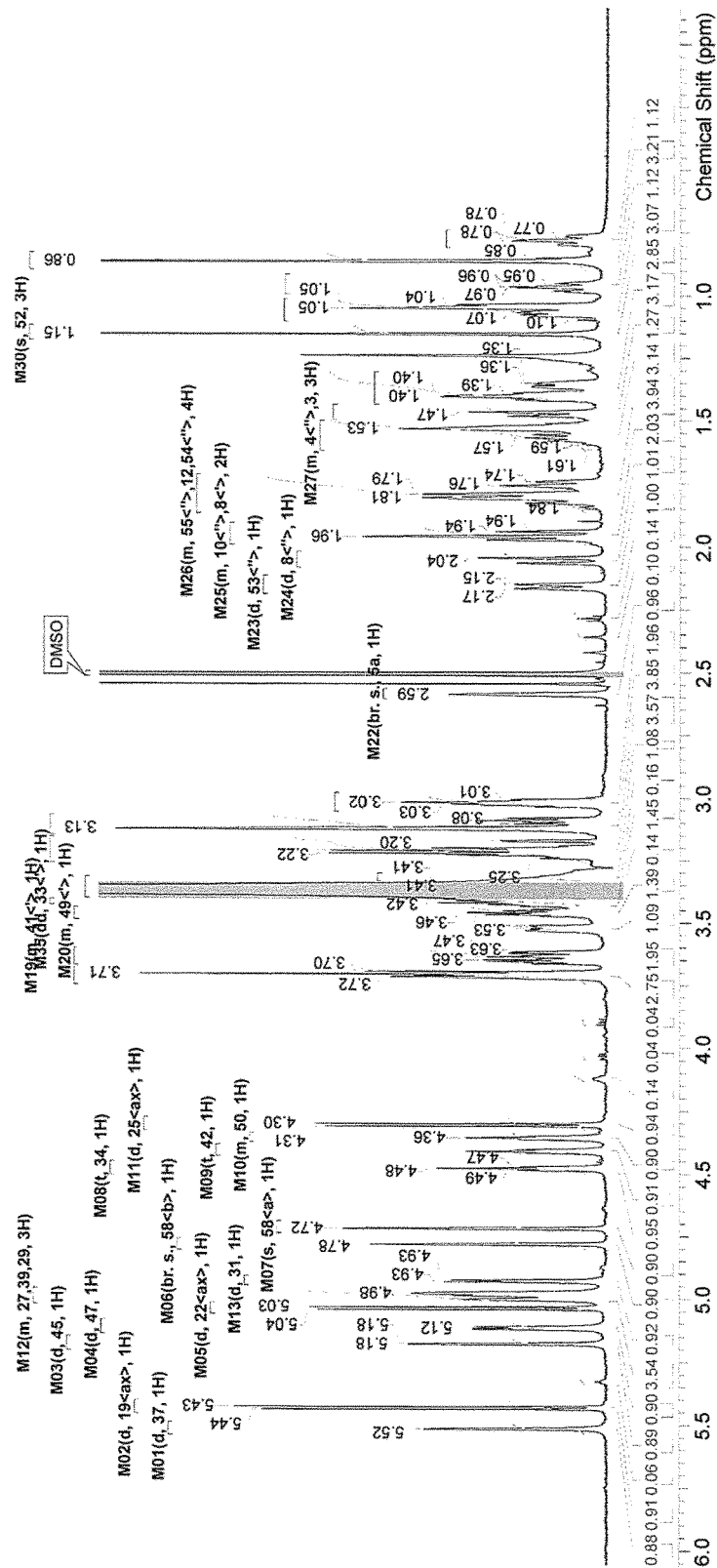
Figure 8D:
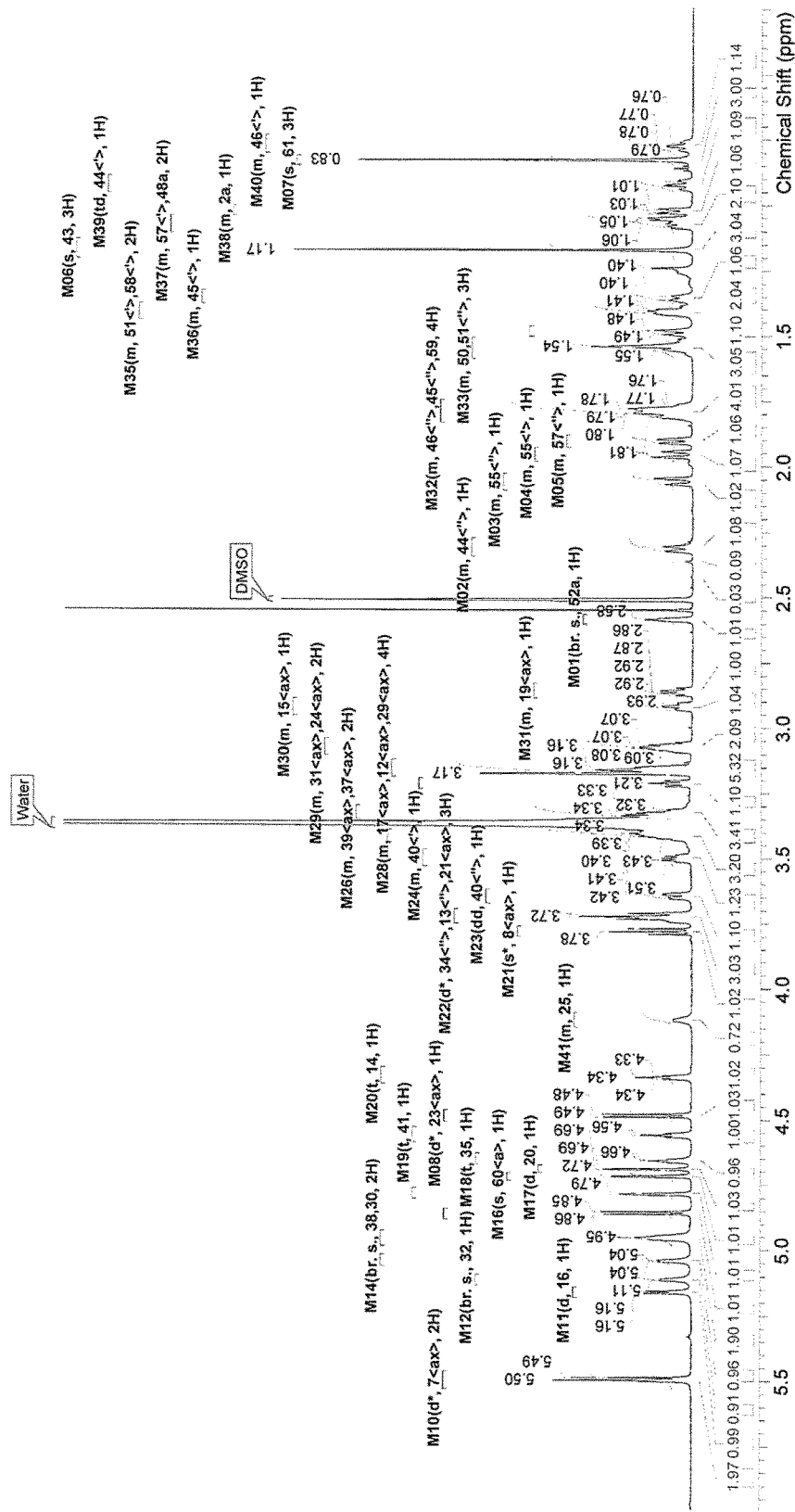
Figure 8F:
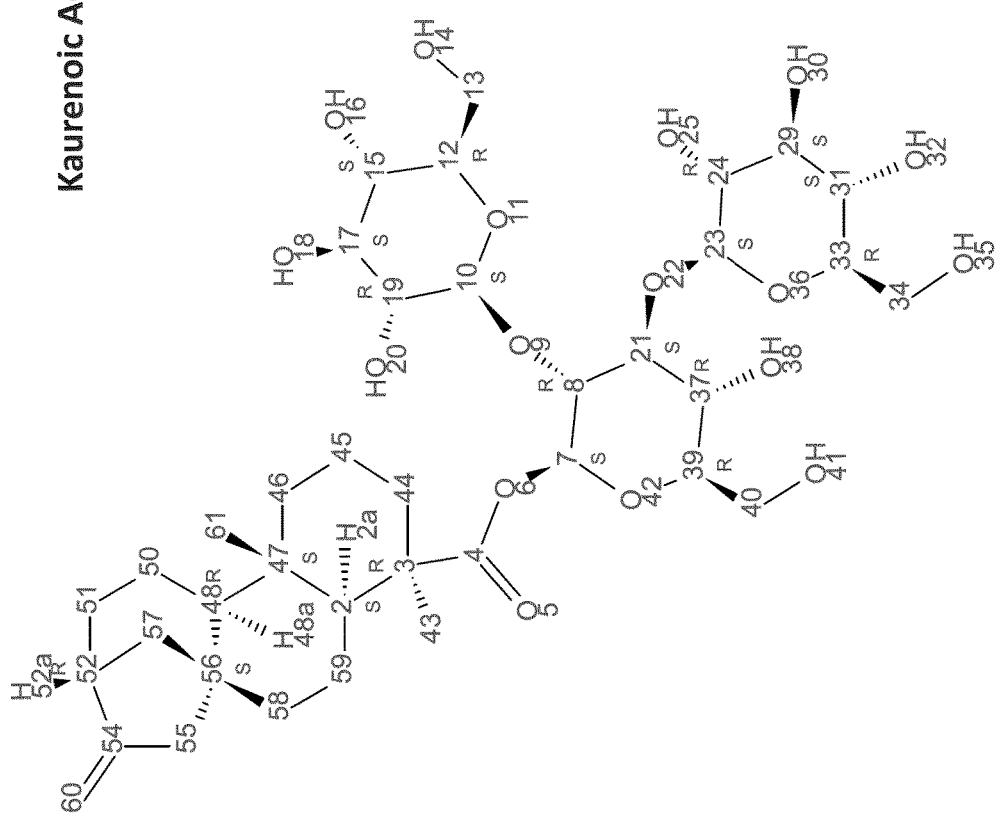
Figure 8G:
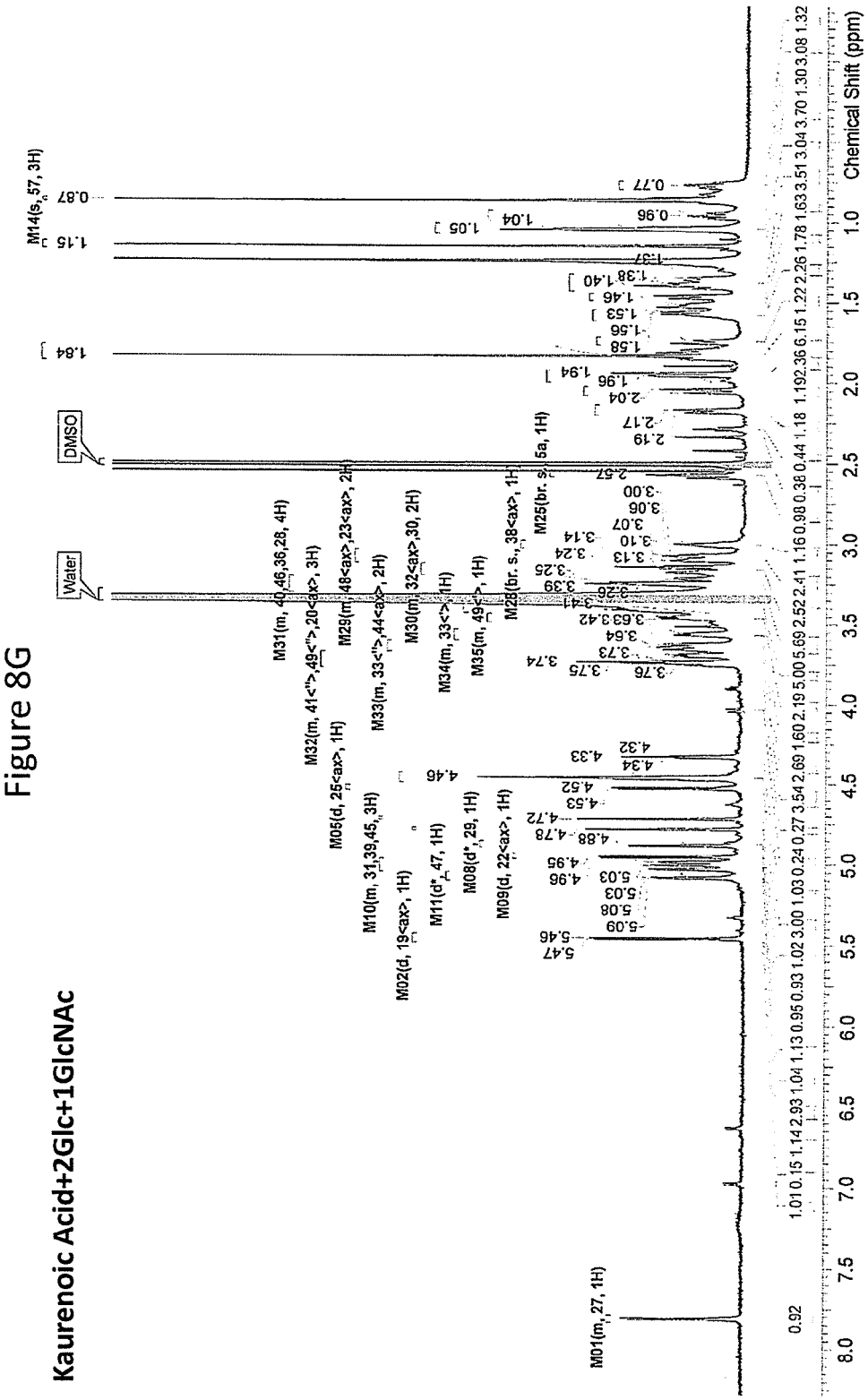
Figure 8I:
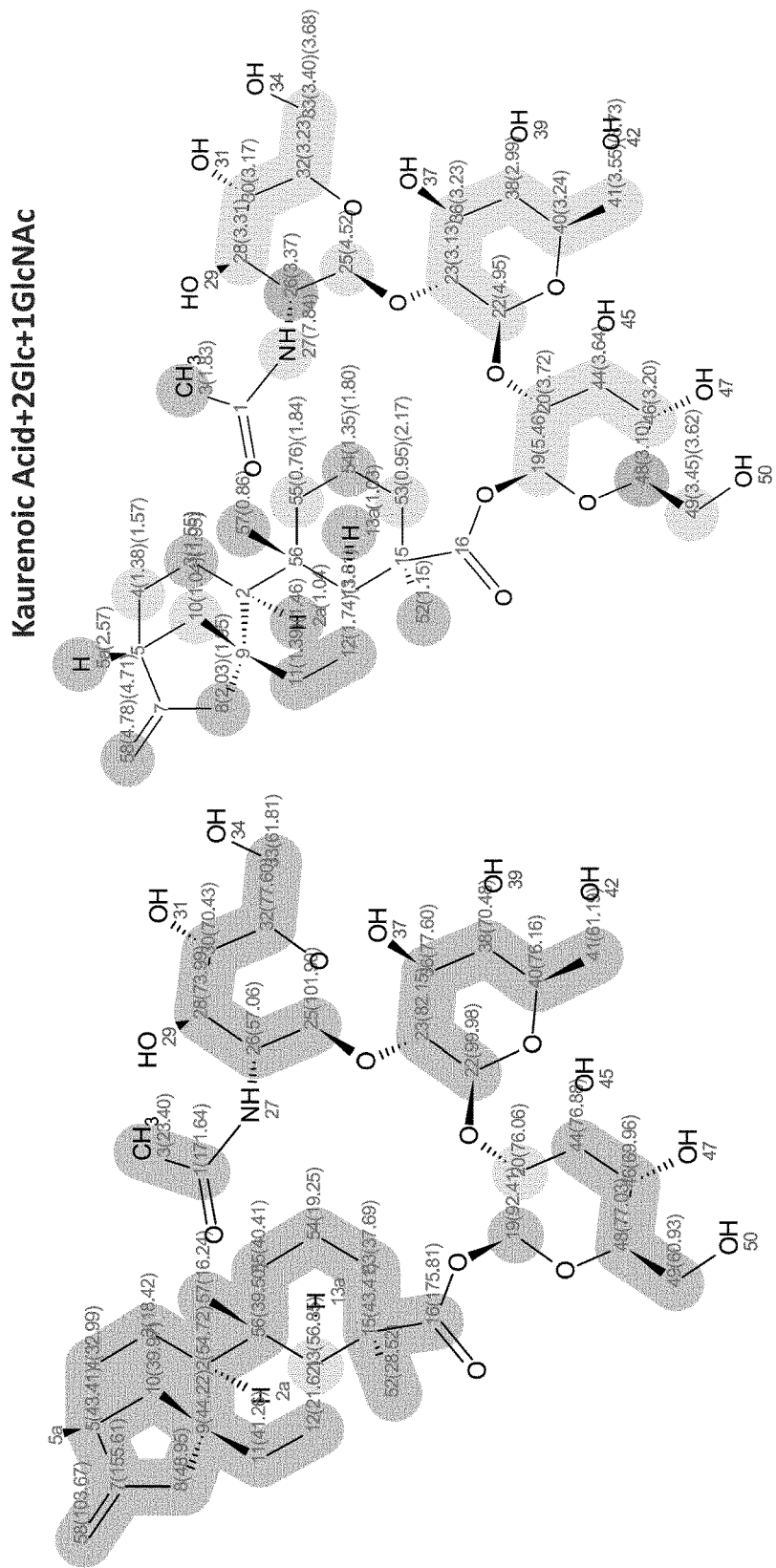
Figure 8J:
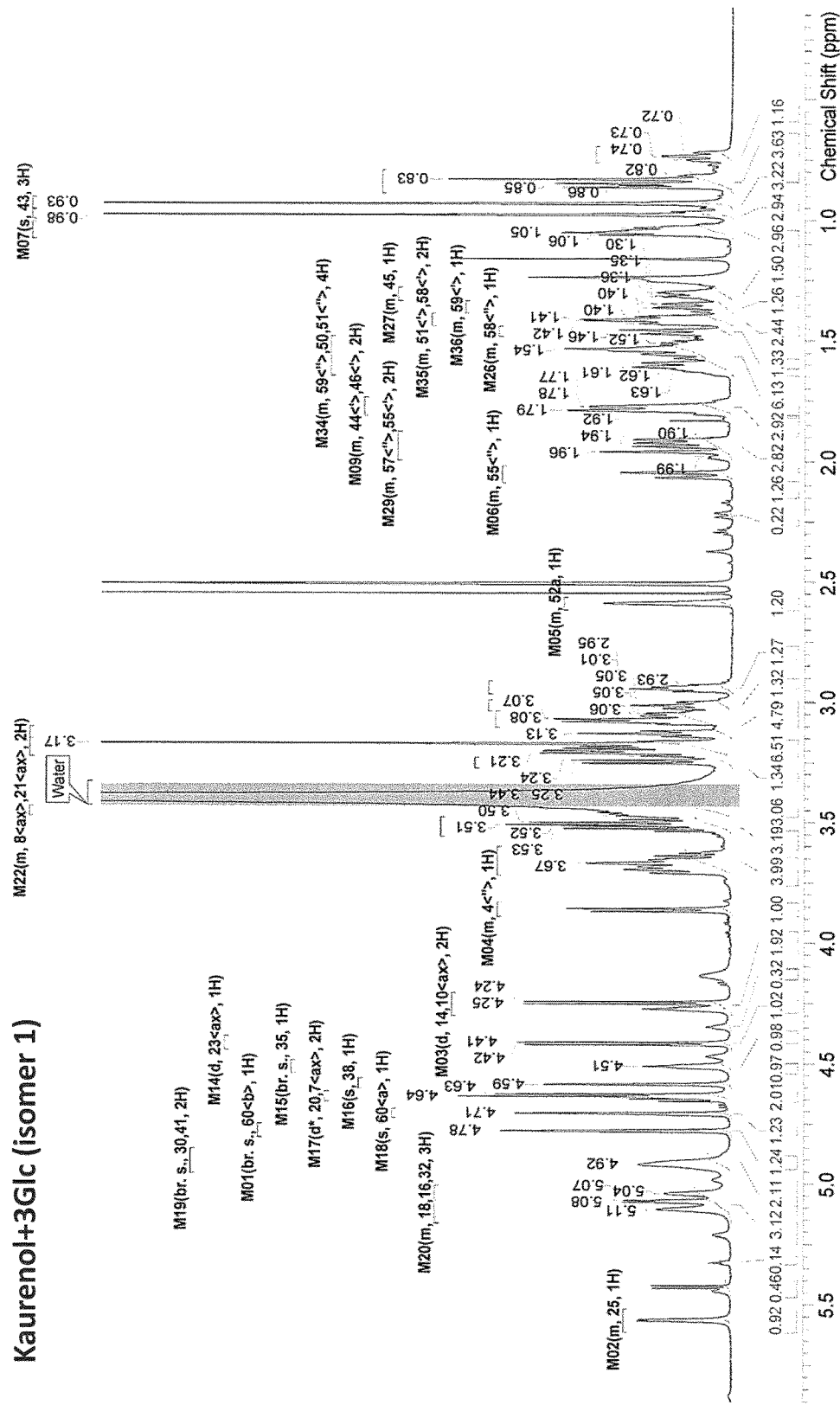
Figure 8K:
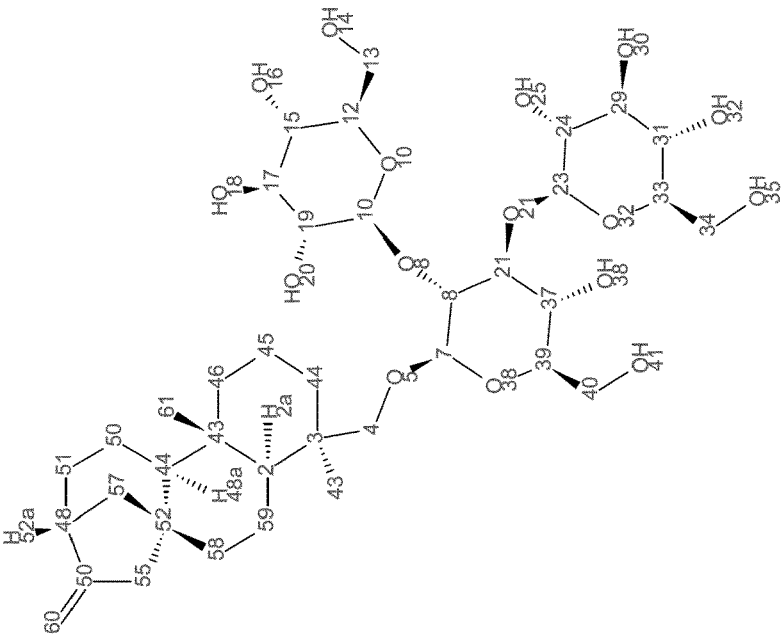
Figure 8M:
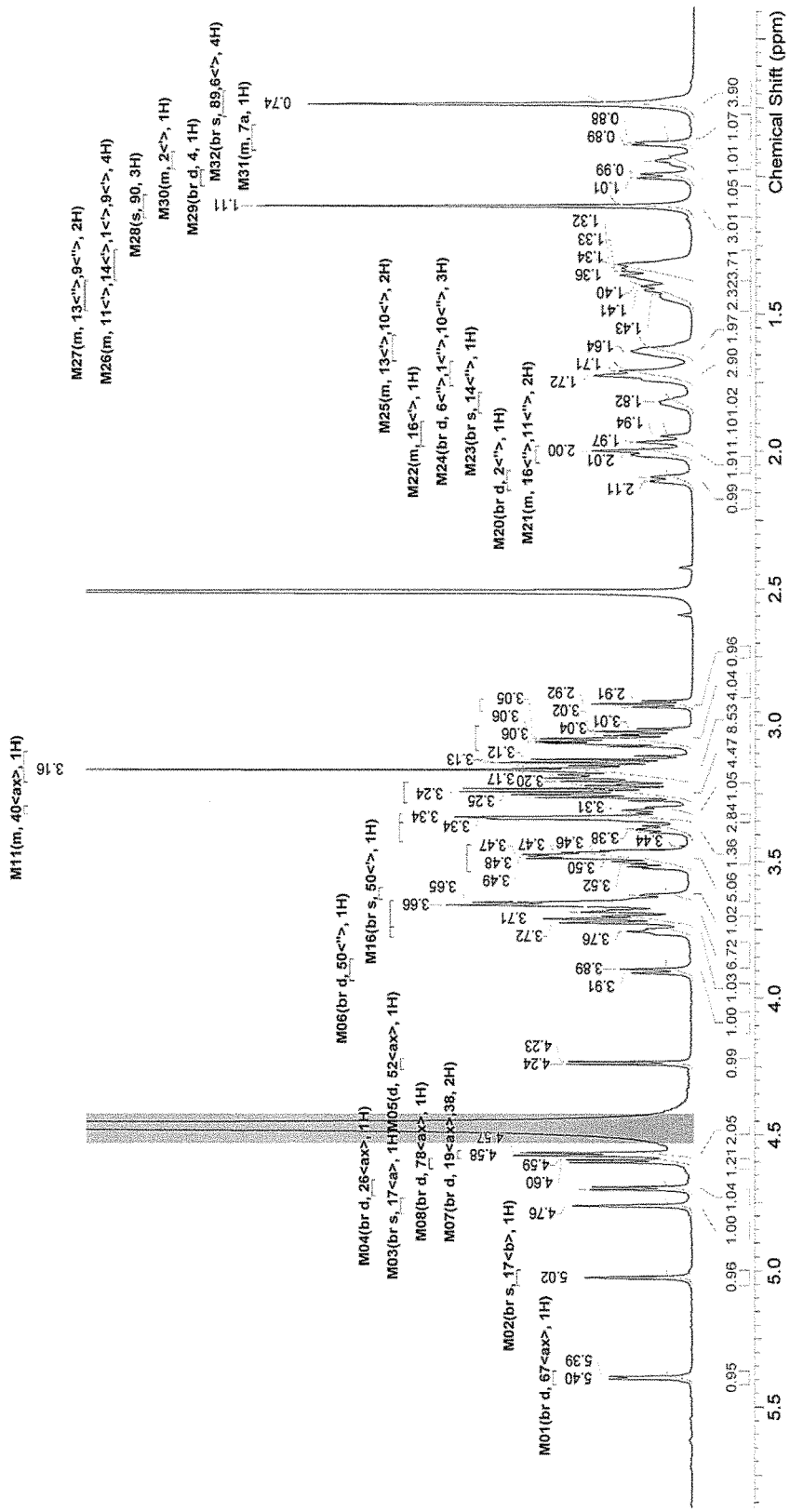
Figure 80:
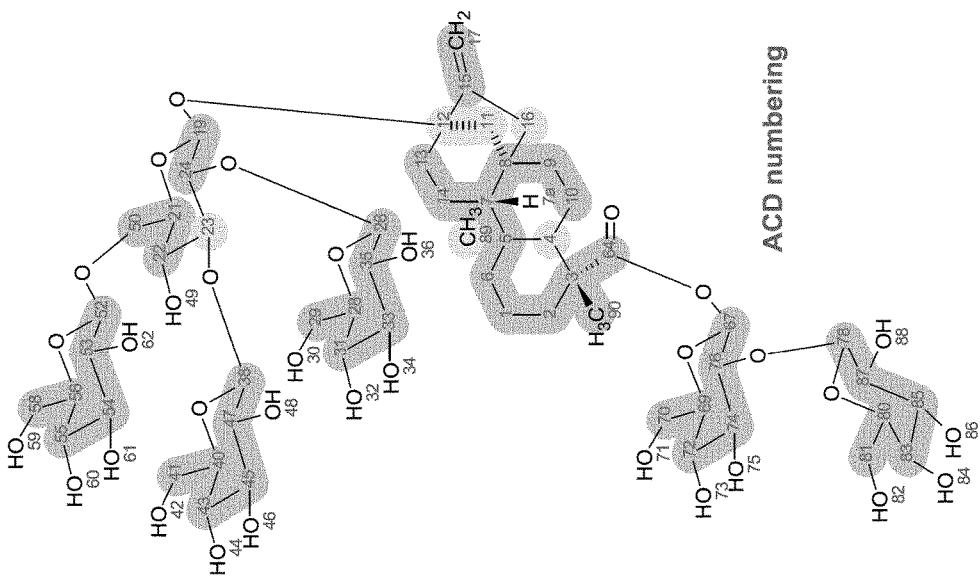
Figure 8P:
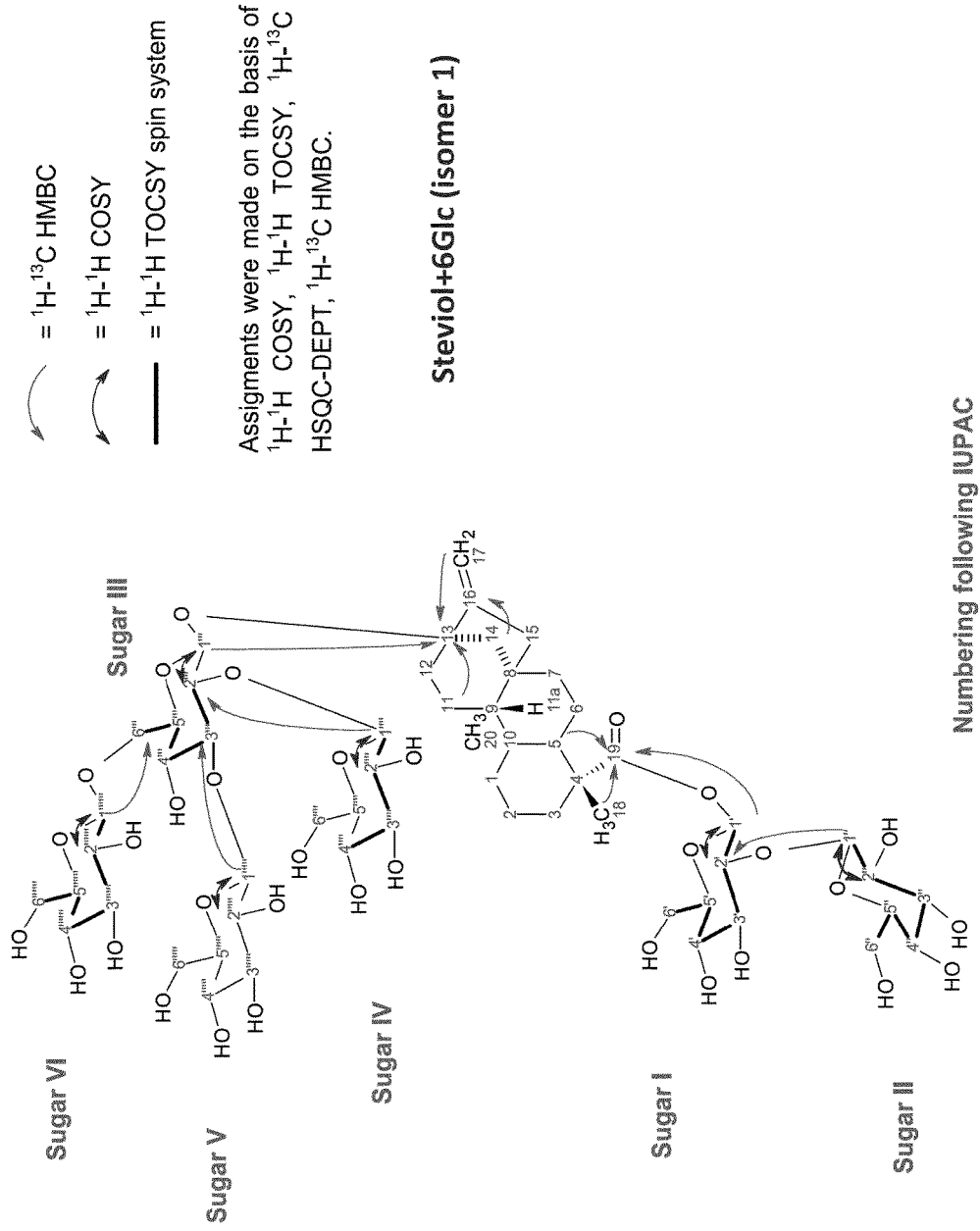
Figure 8Q:
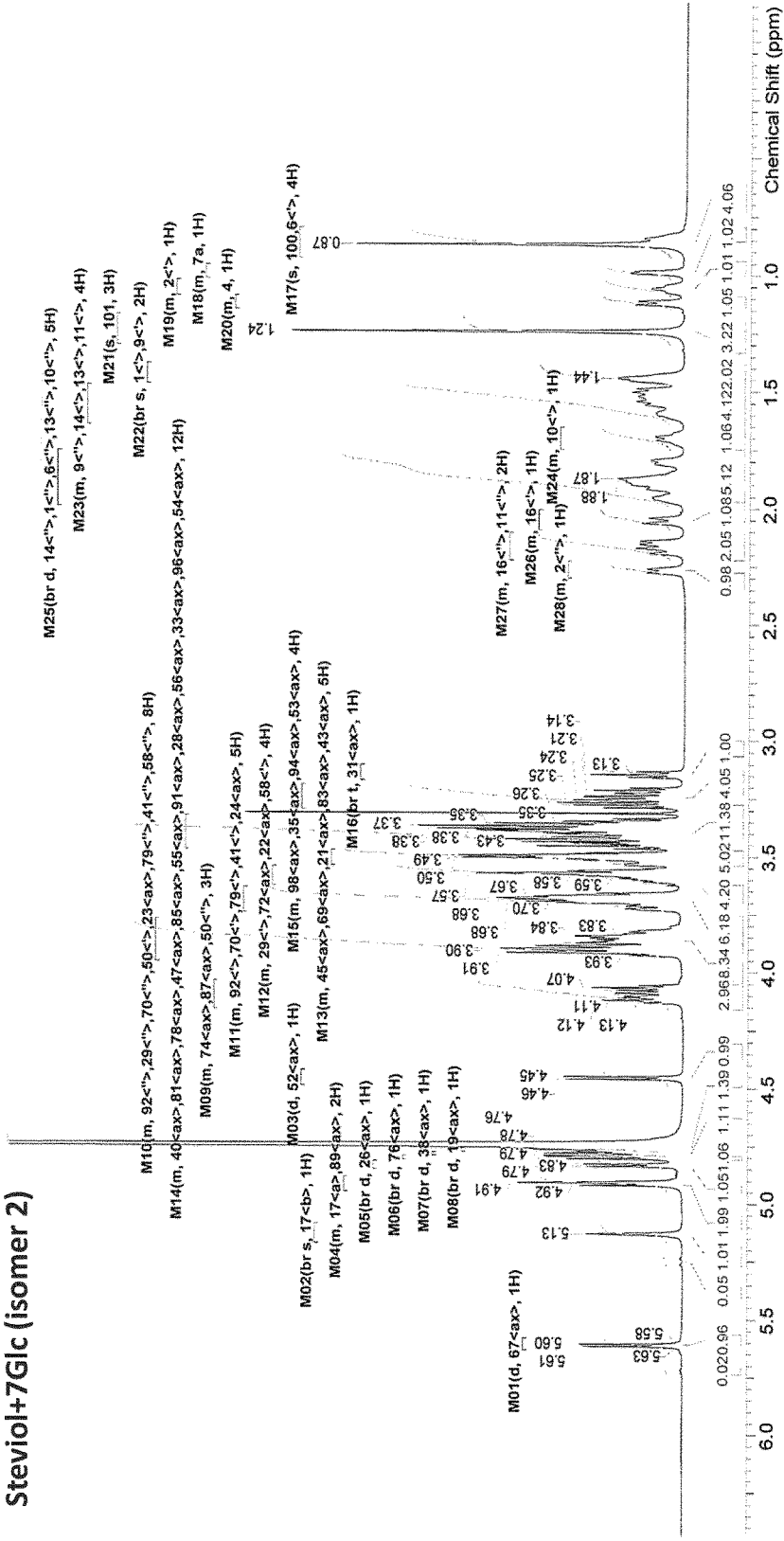
Figure 8S:
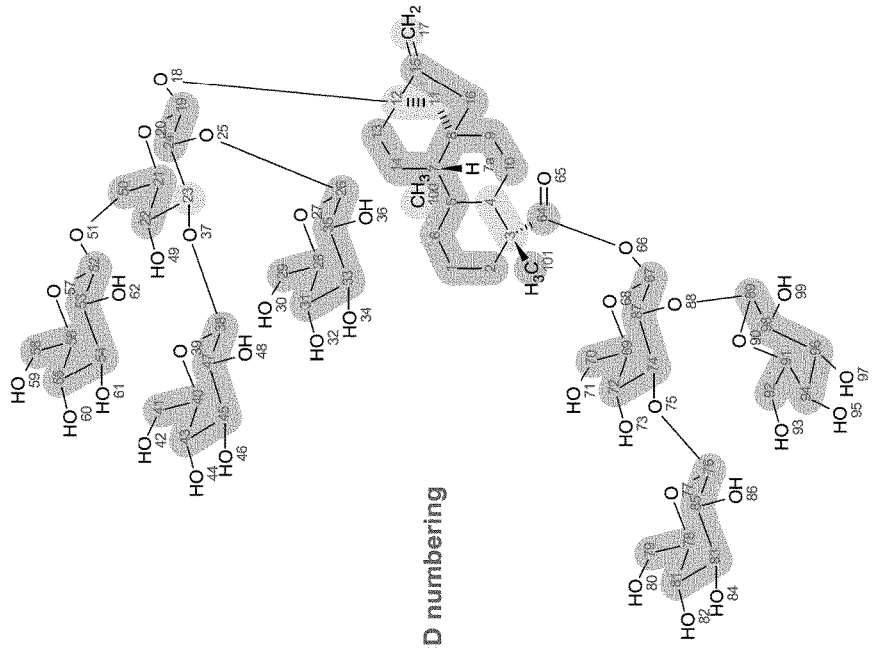
Figure 8T:
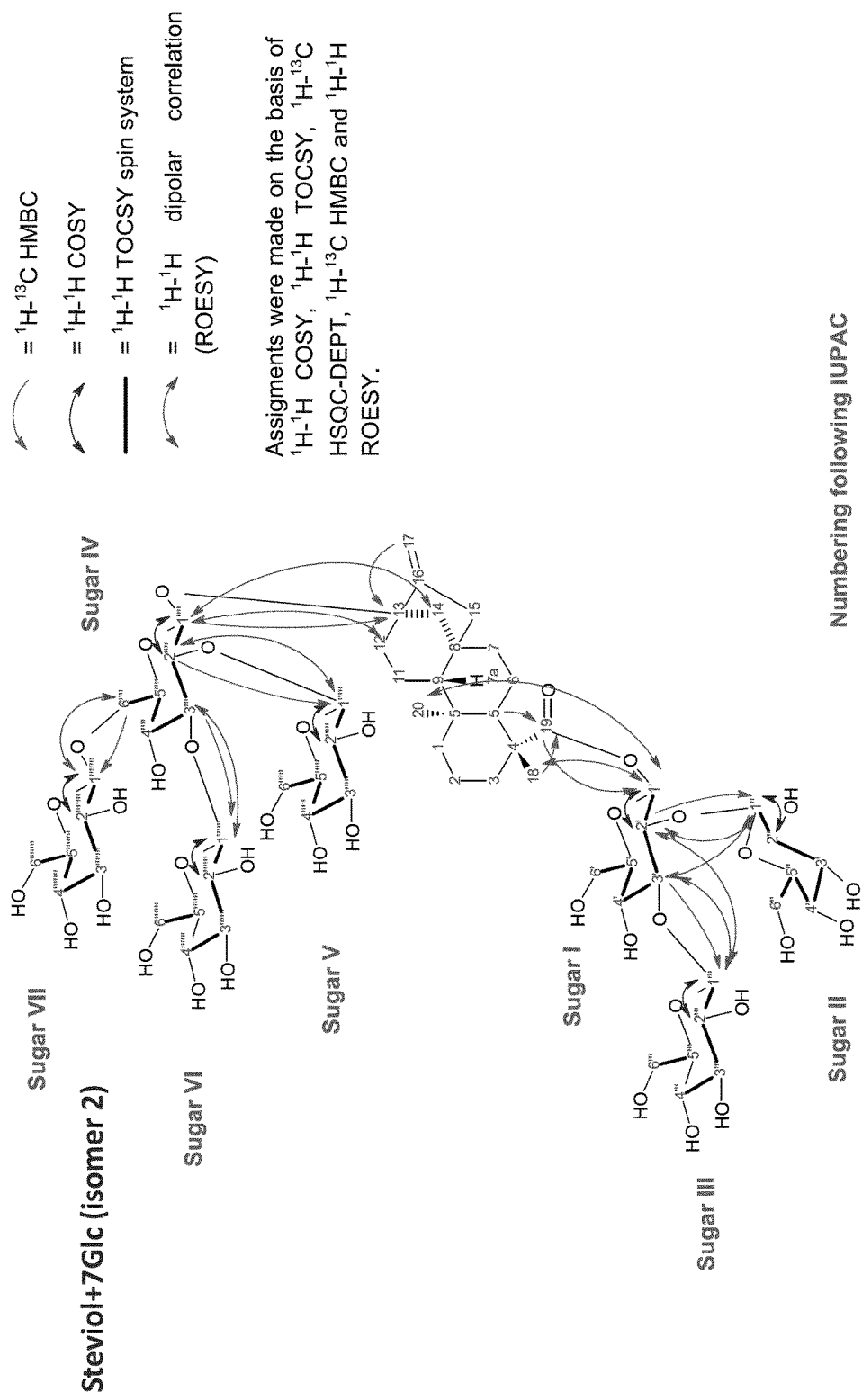
Figure 8U:
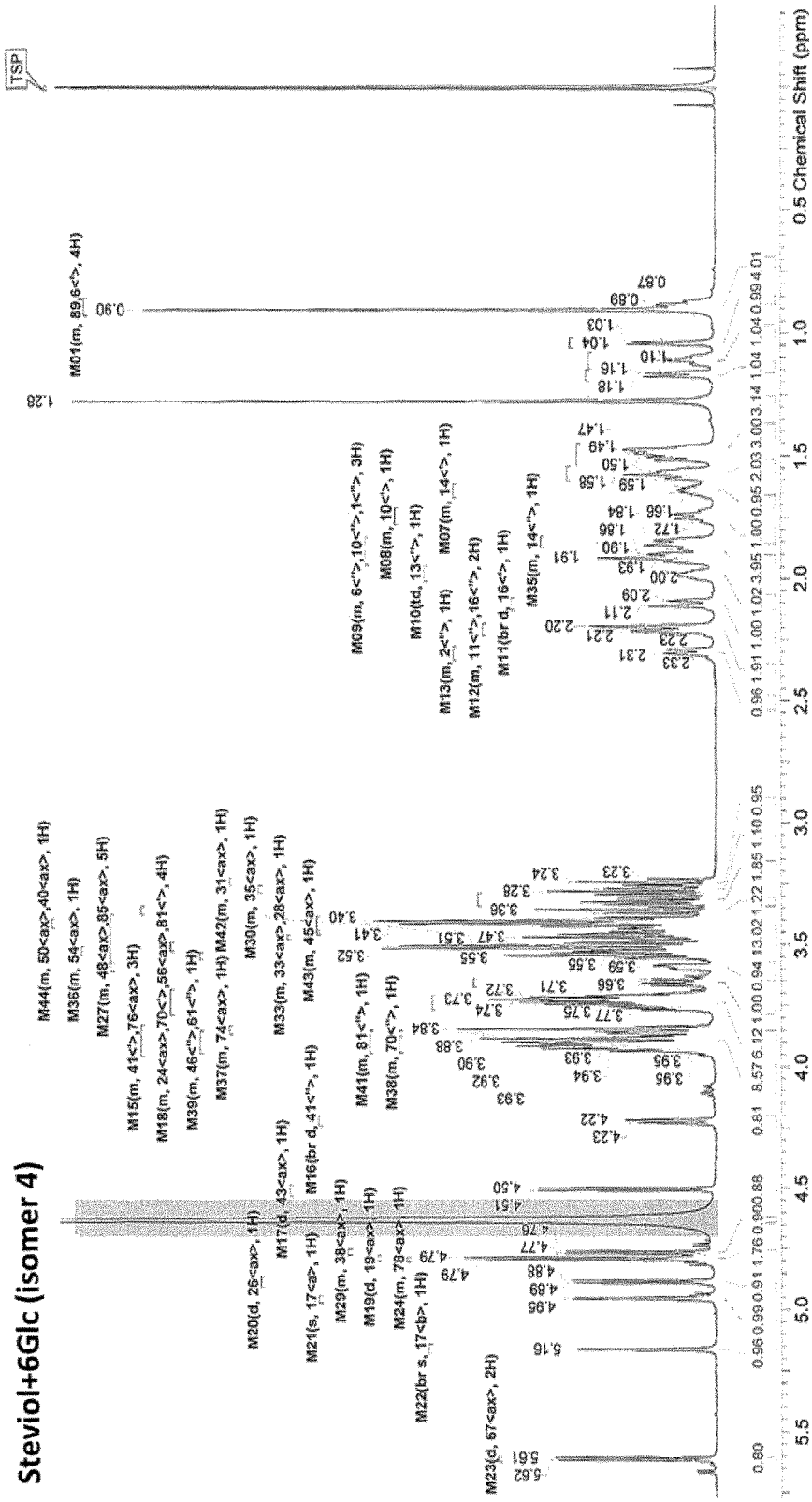
Figure 8W:
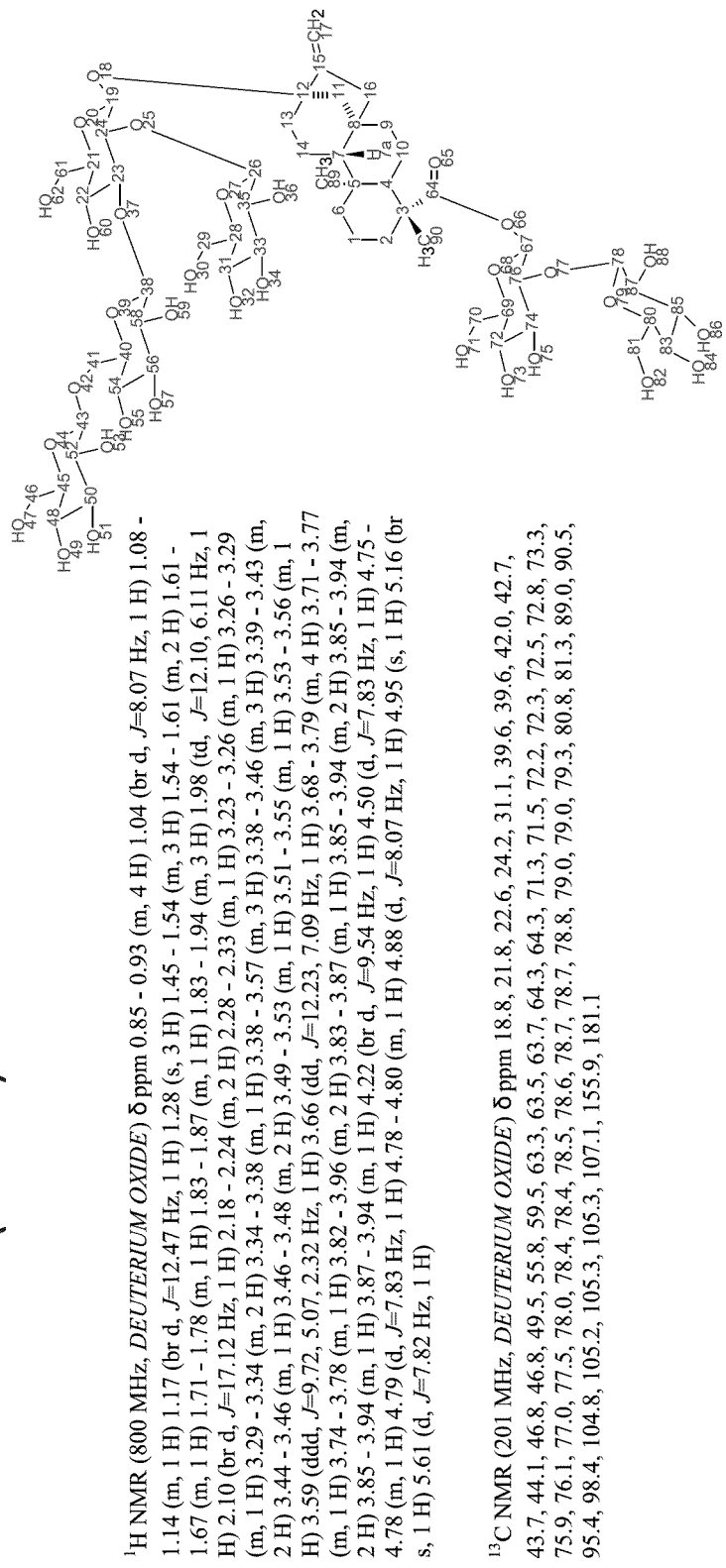
Figure 8Y:
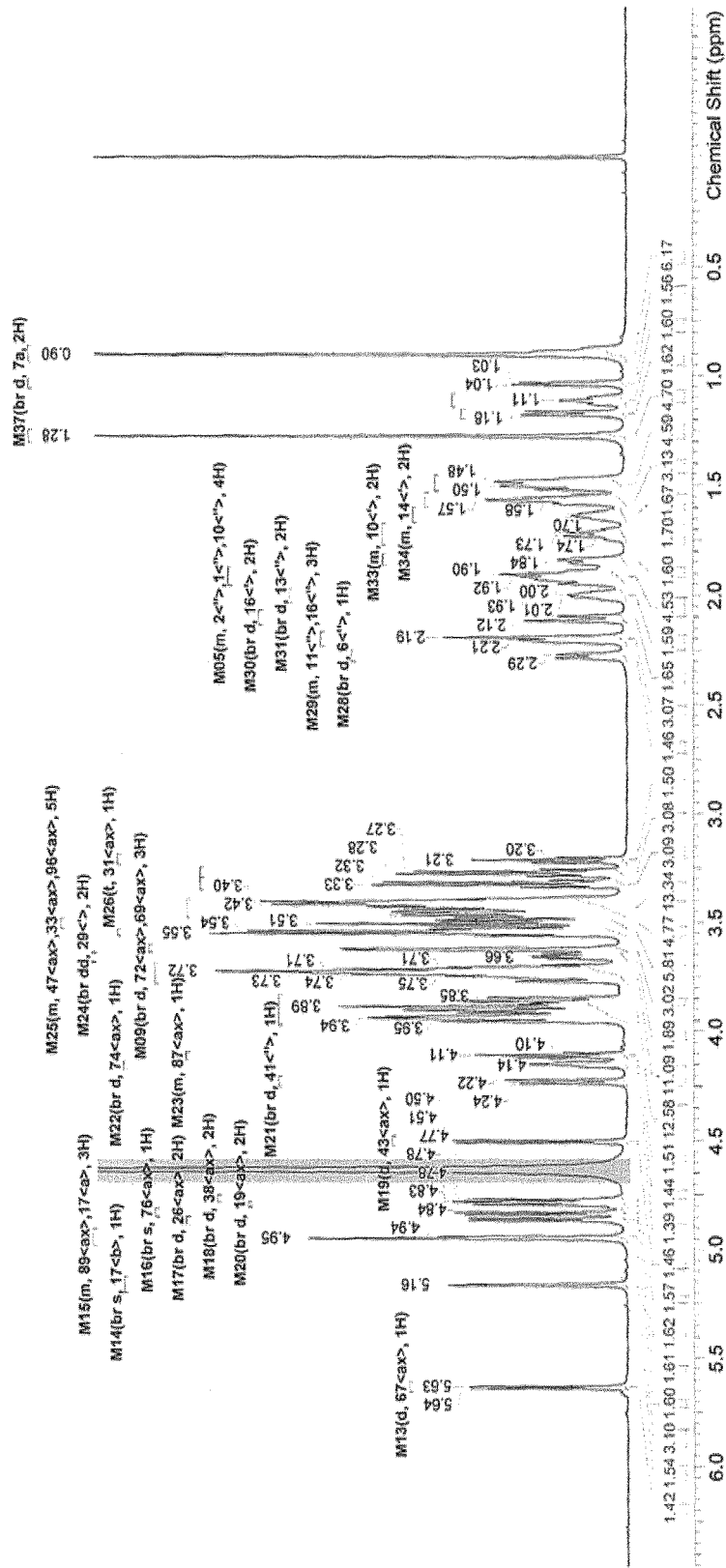
Figure 8A:
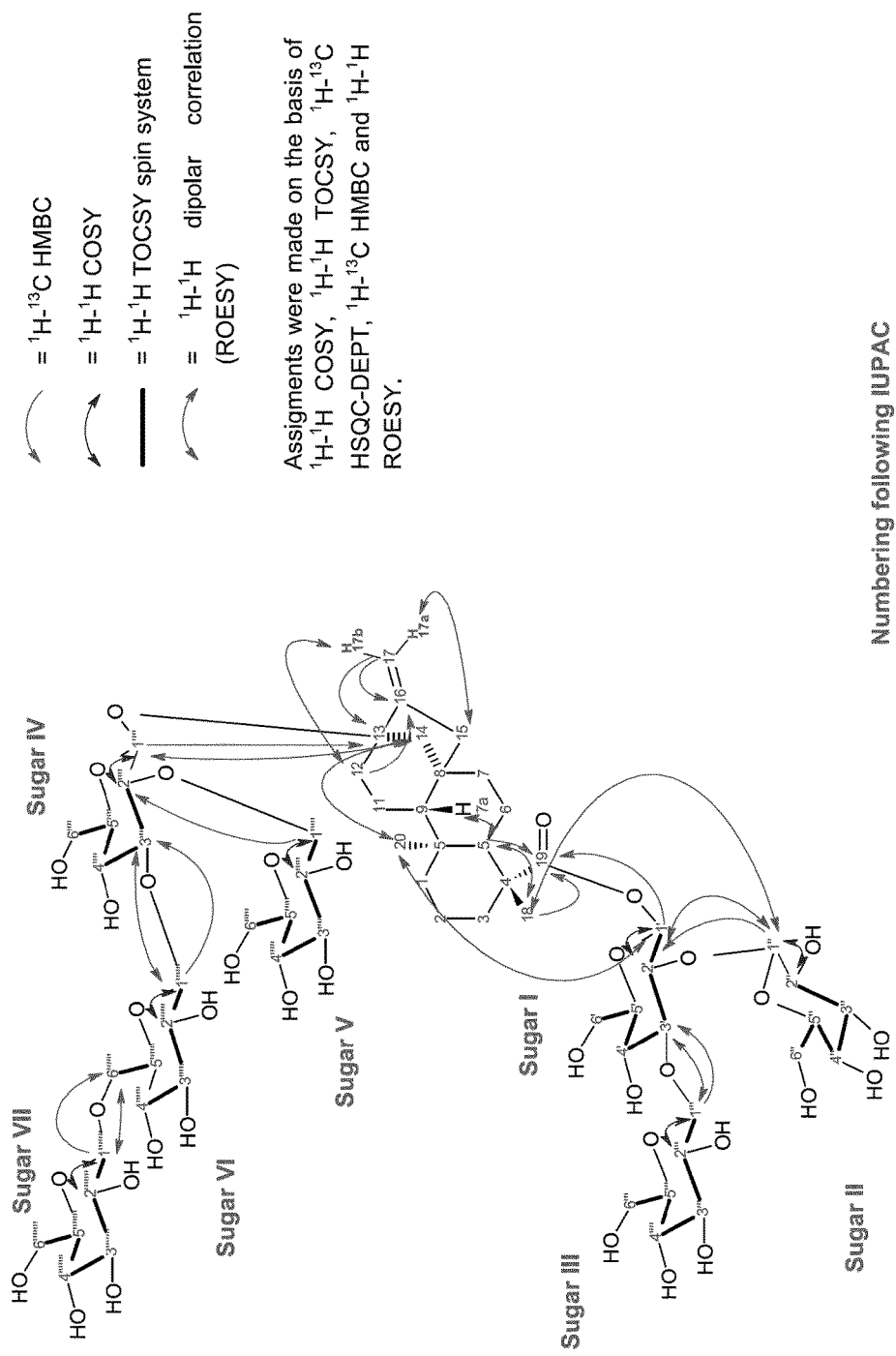
Figure 8A:
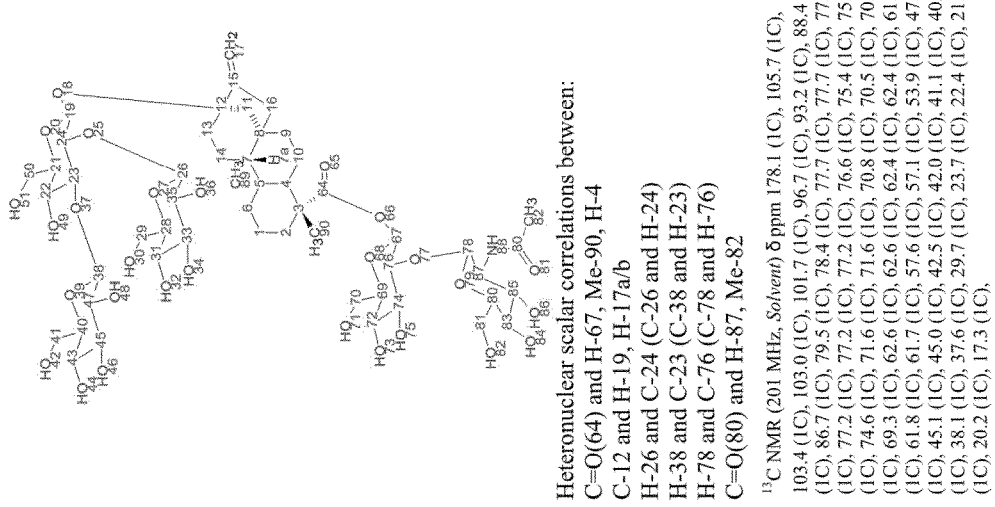
Figure 8A:
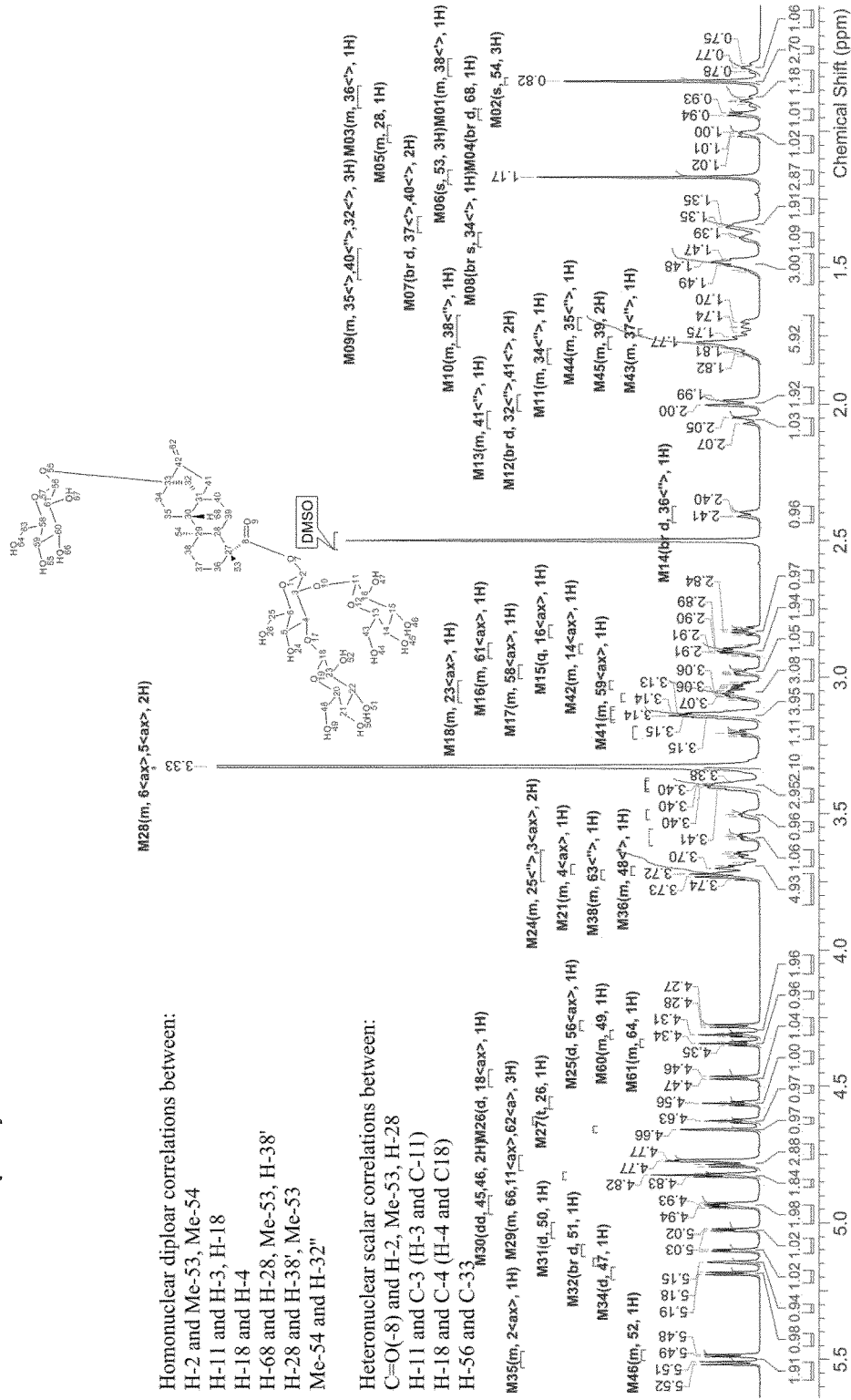
Figure 8A:
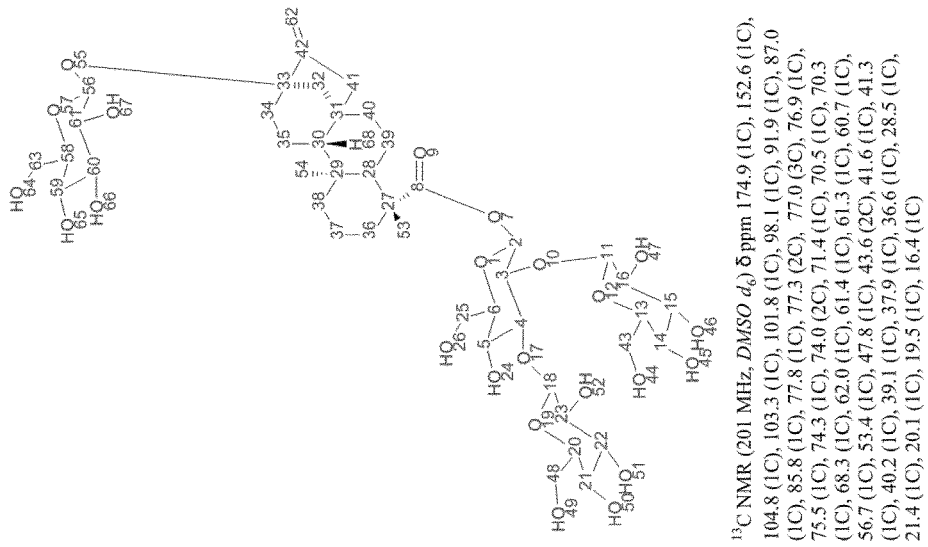
Figure 8A:
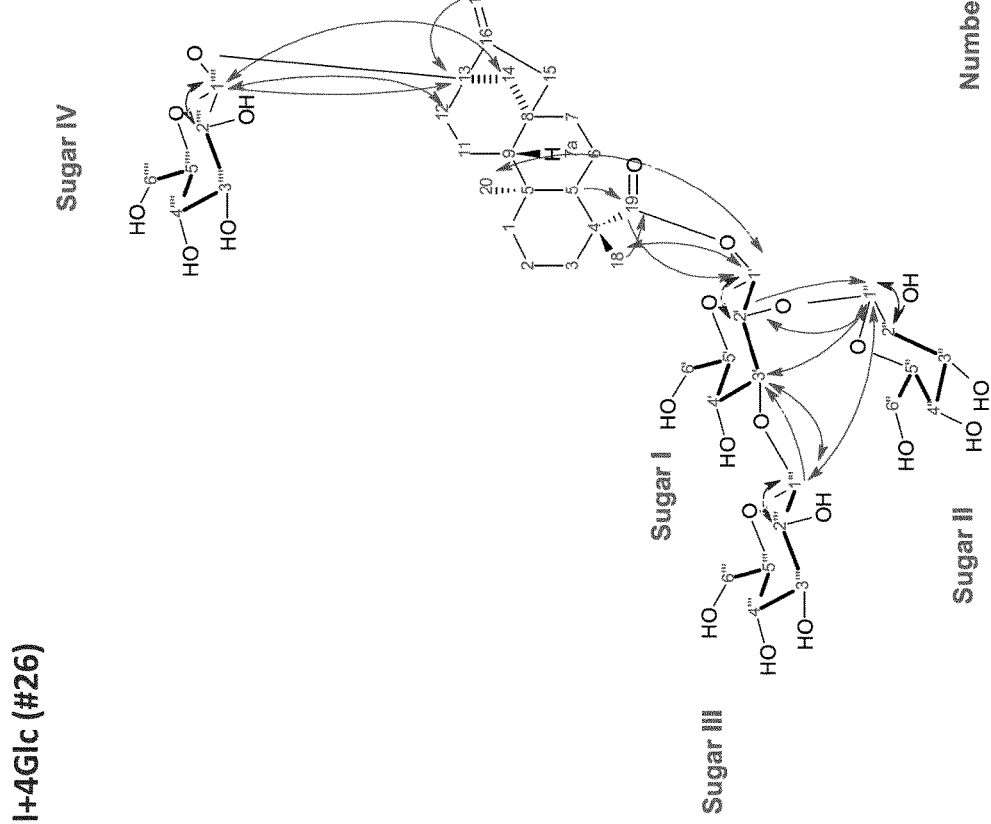
Figure 8A:
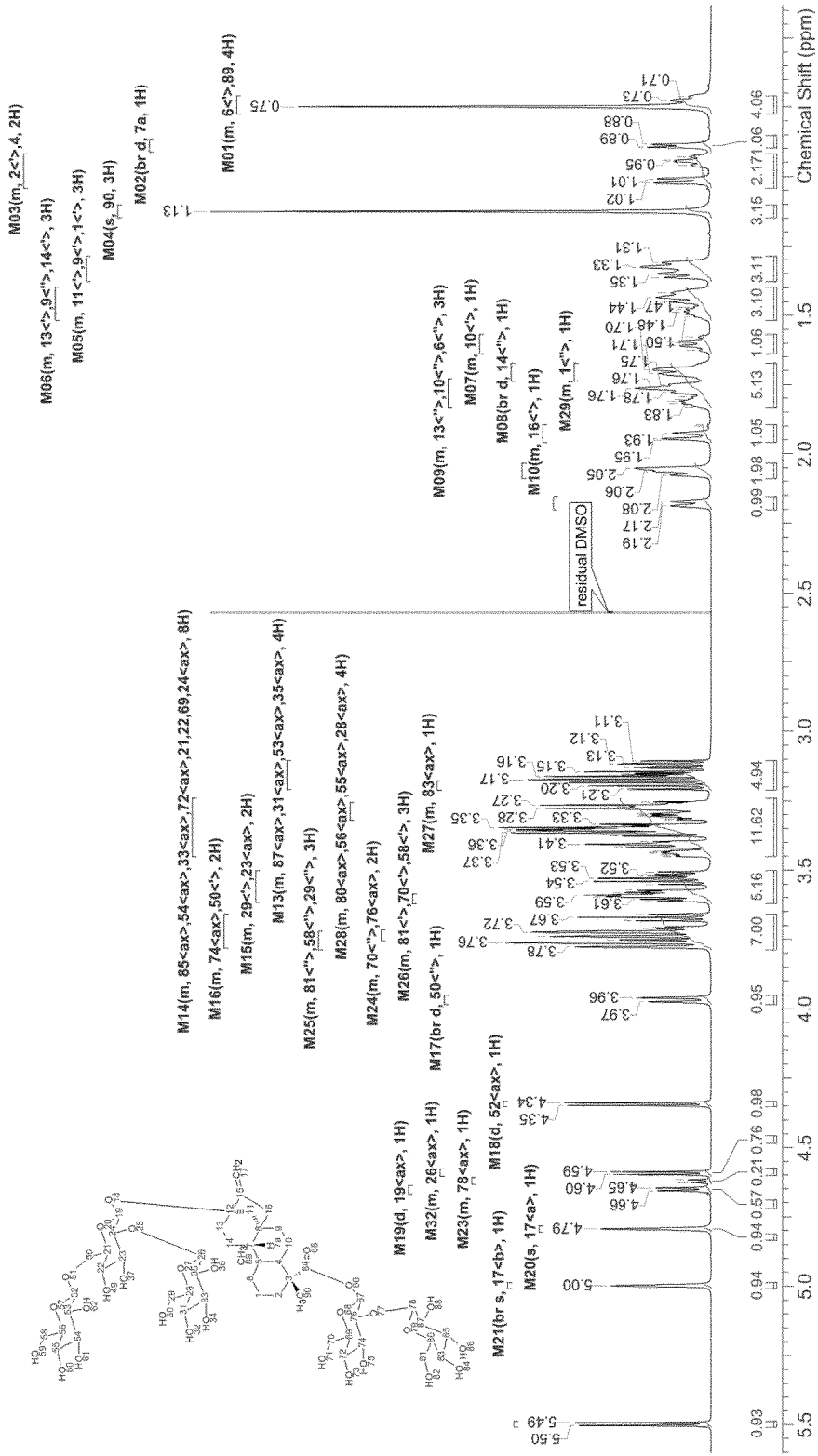
Figure 8A:
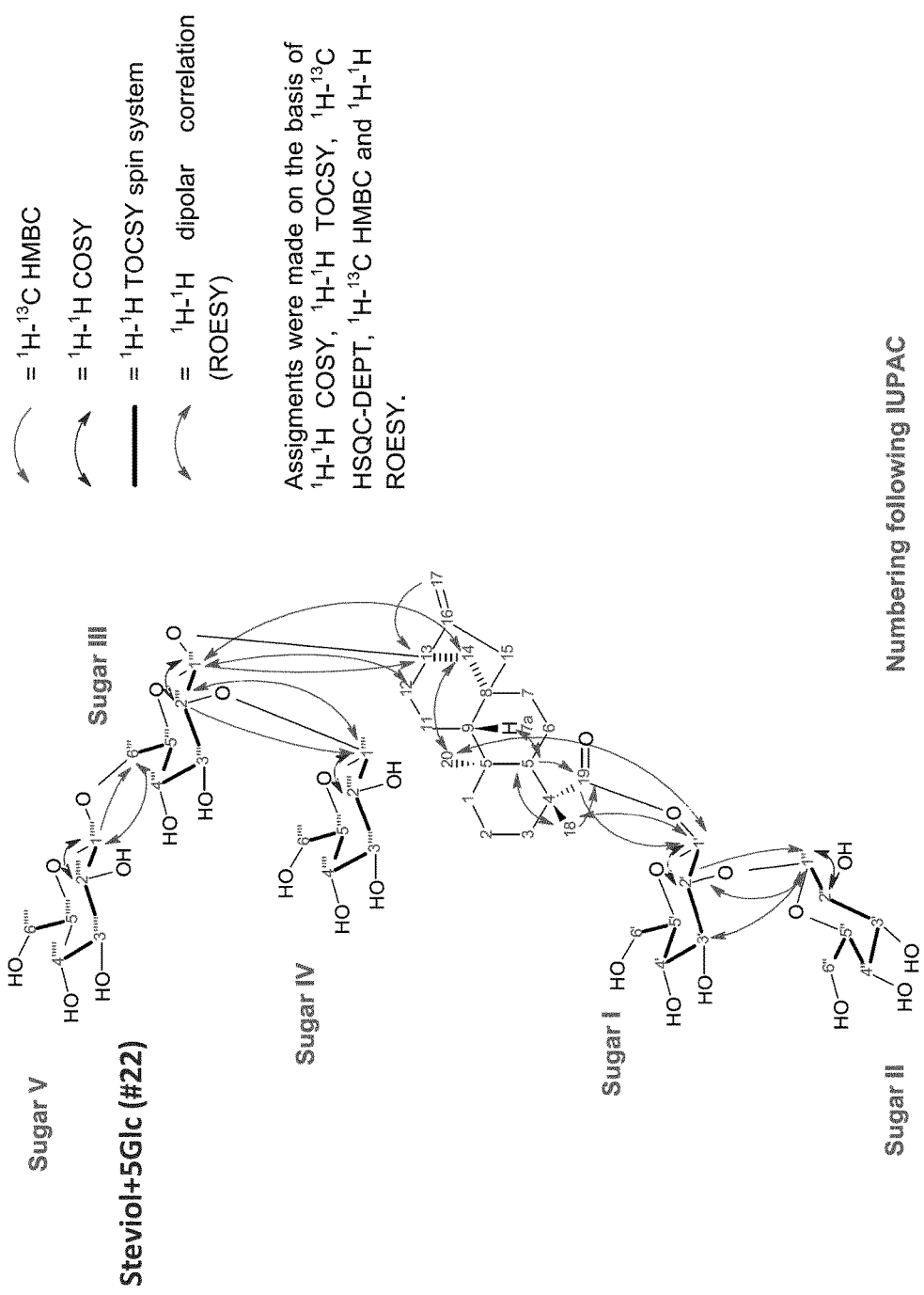
Figure 8A:
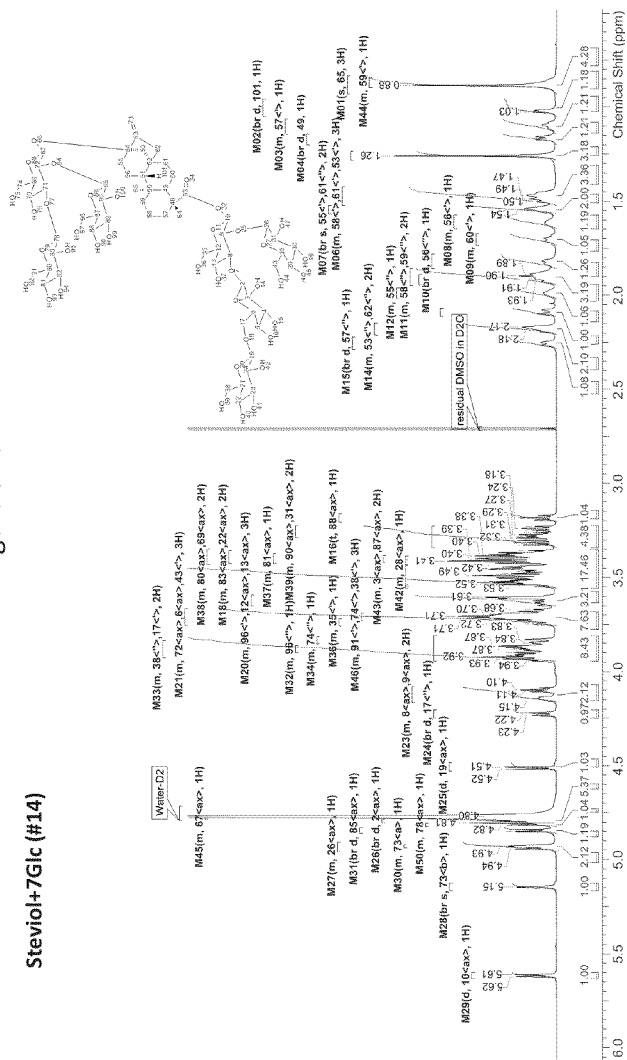

Structures of isolated tri-glycosylated ent-kaurenoic acid, elucidated by NMR, are shown in FIG. 7A, along with a structure of tri-glycosylated ent-kaurenol. These structures were solved by means of standard homo- and heteronuclear multipulse NMR experiments, $^1$H,$^1$H-COSY, $^1$H,$^1$H-ROESY, $^1$H,$^{13}$C-HSQC, and $^1$H,$^{13}$C-HMBC. Compounds were dissolved in 60 µL DMSO-d6 and measured at 25° C. Spectra of these compounds were acquired on an 800 MHz Bruker Avance instrument (800 MHz for $^1$H, 201 MHz for $^{13}$C) equipped with a cryogenic probe (5 mm CPTCI 1H-13C/15N/D Z-GRD Z44909/0010). In addition, $^1$H-NMR spectra were obtained for 3 molecules detected by LC-MS that were concordant with a general ent-kaurenoic acid+2Glc, ent-kaurenol+3Glc (isomer 2), and ent-kaurenol+Glc+GlcNAc structures. See FIGS. 8A-8L for $^1$H NMR spectra and $^1$H and $^{13}$C NMR chemical shifts for these compounds.

UGT85C2 variants were subsequently cloned into USER vectors (for integration at ChrXII-1) using a forward primer (SEQ ID NO:215) and a reverse primer (SEQ ID NO:216) and the PGK1 promoter. The UGT85C2 variants were then integrated into the steviol glycoside-producing strain deleted of UGT85C2. Transformants were re-streaked from transformation plates. Pre-cultures were set up from re-streaked plates in 500 µL synthetic complete-URA (SC-URA) media in a 96 deep well plate (DWP) and grown at 30° C. and 300 rpm overnight. Cultures were set up by transferring 50 µL of the pre-cultures to a 96 well DWP comprising 500 µL SC-URA media.

After 1 day of incubation, cultures were set up from pre-cultures (50 µL in 500 µL SC-URA) and grown in Duetz system for 5 days (same conditions as for pre-cultures). The OD$_{600}$ was measured on plate reader in a 1:10 dilution, and samples were harvested by transferring 50 µL sample to 50 µL 100% DMSO. The mixtures were heated to 80° C. for 10 min and subsequently spun down (4000 rcf, 4° C., 10 min). 15 µL of each supernatant were mixed with 105 µL 50% DMSO (total dilution of 1:16), and the samples were analyzed by LC-MS.

Example 7: Assessment of UGT85C2 Variant Activity in Cell Lysates

Purified variant UGT85C2 DNA from Example 6 was individually transformed into XJB autolysis z-competent cells. Pre-cultures of three colonies from each transformation plate were inoculated into 600 µL LB comprising kanamycin (600 mg/L) and incubated overnight at 200 rpm and 37° C. in a 96 well DWP. Protein production and cell wall degradation were induced by transferring 50 µL of the pre-cultures to a new 96 well DWP comprising 1 mL/well of NZCYM broth comprising kanamycin (600 mg/L)+3 mL/L 1M Arabinose and 100 µL/L 1M IPTG. Cultures were incubated at 20° C., 200 rpm for approximately 20 h before pelleting the cells (4000 rcf, 5 min, 4° C.) and removing the supernatant. To each well, 50 µL GT buffer with protease inhibitor (cOmplete™, Mini, EDTA-free Protease Inhibitor Cocktail Tablets, 11836170001 Roche) was added. Pellets were resuspended by shaking at 200 rpm for 5 min at 4° C. A 75 µL aliquot of each sample was transferred to a PCR plate and frozen at −80° C. Pellets were thawed at room temperature, and 25 µL/well DNAse mix (2.39 mL 4×binding buffer+50 µL DNAse I (1.4 mg/mL)+60 µL MgCl$_2$ (1 M) per plate) were added when samples were nearly thawed. The plate was incubated at room temperature for 5 min with gentle shaking and subsequently centrifuged at 4000 rcf for 5 min. Each supernatant was transferred to a fresh PCR plate for activity measurements.

Each supernatant was incubated in an assay reaction mix comprising a final concentration of 100 mM Tris (pH 8.0), 4 mM MgCl$_2$, 1 mM KCl, 300 µM UDP-Glucose, and 100 µM substrate. The substrates were either steviol or 19-SMG. A purified wild-type UGT85C2 enzyme and a UGT85C2 bacterial lysate were used as positive controls. Reactions were incubated at 30° C. (on a plate shaker), and the reactions were stopped after 20 min, 40 min, and 19 h by mixing 20 µL sample with 20 µL 100% DMSO. The samples were further diluted by adding 60 µL 50% DMSO and subsequently analyzed by LC-MS. AUC values corresponding to measured 13-SMG, 19-SMG, rubusoside, and steviol levels are shown in Tables 8A-C.

TABLE 8A

Measured 13-SMG and steviol AUC values in UGT85C2 variant activity assay using steviol as a substrate.

| | 13-SMG | | | Steviol | | |
|---|---|---|---|---|---|---|
| UGT85C2 Variant | 20 min | 40 min | 19 h | 20 min | 40 min | 19 h |
| F48S (SEQ ID NO: 150) | 38195 | 55395 | 76045 | 21355 | 9955 | |
| F48H (SEQ ID NO: 151) | 49840 | 64105 | 79000 | 17670 | 4035 | |
| F48Y (SEQ ID NO: 152) | 36980 | 53005 | 83100 | 26675 | 16135 | |
| F48R (SEQ ID NO: 153) | 37990 | 55510 | 71810 | 25540 | 11075 | |
| F48Q (SEQ ID NO: 154) | 33660 | 46010 | 72550 | 30565 | 16135 | |
| F48W (SEQ ID NO: 155) | 37580 | 56220 | 76490 | 25280 | 8615 | |
| F48T (SEQ ID NO: 156) | 40505 | 57280 | 78080 | 20405 | 10340 | |
| I49V (SEQ ID NO: 157) | 48345 | 60720 | 75420 | 17545 | 4305 | |
| S84G (SEQ ID NO: 158) | 33960 | 50770 | 76070 | 29500 | 15870 | |
| S84A (SEQ ID NO: 159) | 43135 | 62000 | 75715 | 21445 | 5190 | |
| S84C (SEQ ID NO: 161) | 25780 | 39330 | 71060 | 34285 | 22700 | |
| S84V (SEQ ID NO: 164) | 27045 | 43200 | 74505 | 32100 | 17715 | |
| P86R (SEQ ID NO: 165) | 23240 | 34440 | 71955 | 33670 | 25395 | |
| P86G (SEQ ID NO: 166) | 28000 | 43525 | 74300 | 27640 | 14380 | |
| I87H (SEQ ID NO: 167) | 7290 | 10465 | 43495 | 51340 | 41690 | 21865 |
| I87P (SEQ ID NO: 168) | 32165 | 48565 | 76700 | 29475 | 13945 | |
| I87Y (SEQ ID NO: 170) | 36905 | 47250 | 71390 | 31220 | 14065 | |
| L91K (SEQ ID NO: 171) | 25810 | 37830 | 72435 | 29455 | 19015 | 2770 |
| L91R (SEQ ID NO: 172) | 27560 | 40235 | 75830 | 34275 | 22140 | 2470 |
| L92F (SEQ ID NO: 174) | 49205 | 62540 | 72385 | 15635 | 3570 | |

TABLE 8B

Measured 13-SMG, 19-SMG, and rubusoside AUC values in UGT85C2 variant activity assay using 19-SMG as a substrate.

| UGT85C2 Variant | 19-SMG | | | rubusoside | | |
|---|---|---|---|---|---|---|
| | 20 min | 40 min | 19 h | 20 min | 40 min | 19 h |
| F48S (SEQ ID NO: 150) | 171625 | 147690 | 3720 | 18935 | 30650 | 92800 |
| F48H (SEQ ID NO: 151) | 165365 | 129495 | 1830 | 24415 | 40520 | 99660 |
| F48Y (SEQ ID NO: 152) | 161680 | 128705 | 2815 | 23130 | 39385 | 97180 |
| F48R (SEQ ID NO: 153) | 166035 | 142095 | 6120 | 17335 | 30075 | 93750 |
| F48Q (SEQ ID NO: 154) | 169560 | 145130 | 3235 | 16570 | 28495 | 81190 |
| F48W (SEQ ID NO: 155) | 168175 | 147640 | 3920 | 16040 | 28030 | 95530 |
| F48T (SEQ ID NO: 156) | 166190 | 134425 | 2960 | 22445 | 37520 | 96620 |
| I49V (SEQ ID NO: 157) | 170460 | 133705 | 1935 | 20340 | 35300 | 97440 |
| S84G (SEQ ID NO: 158) | 175515 | 147045 | 3165 | 14645 | 24745 | 91945 |
| S84A (SEQ ID NO: 159) | 163565 | 131735 | 1790 | 19805 | 31845 | 90090 |
| S84C (SEQ ID NO: 161) | 183175 | 159805 | 44230 | 11040 | 17040 | 77130 |
| S84V (SEQ ID NO: 164) | 183415 | 168240 | 6600 | 11975 | 20075 | 98555 |
| P86R (SEQ ID NO: 165) | 186925 | 154290 | 12670 | 12075 | 20350 | 85755 |
| P86G (SEQ ID NO: 166) | 175265 | 146080 | 5720 | 17660 | 29815 | 93195 |
| I87H (SEQ ID NO: 167) | 197170 | 191250 | 149025 | 3045 | 5300 | 27610 |
| I87P (SEQ ID NO: 168) | 167935 | 143945 | 8795 | 16675 | 28290 | 96865 |
| I87Y (SEQ ID NO: 170) | 176815 | 142820 | 4750 | 16635 | 26615 | 93205 |
| L91K (SEQ ID NO: 171) | 188110 | 182210 | 177120 | 5350 | 8545 | 20345 |
| L91R (SEQ ID NO: 172) | 188750 | 180040 | 149165 | 7535 | 12140 | 29160 |
| L92F (SEQ ID NO: 174) | 187295 | 155170 | 2695 | 11335 | 22340 | 98920 |

TABLE 8C

Measured 13-SMG, 19-SMG, rubusoside, and steviol AUC values in control UGT85C2 assays.

| | 13-SMG | | | 19-SMG | | | rubusoside | | | Steviol | | |
|---|---|---|---|---|---|---|---|---|---|---|---|---|
| | 20 min | 40 min | 19 h | 20 min | 40 min | 19 h | 20 min | 40 min | 19 h | 20 min | 40 min | 19 h |
| Substrate: Steviol WT UGT85C2 (SEQ ID NO: 7) | 60635 | 67575 | 73750 | | | | | | 490 | | | |
| Substrate: 19-SMG WT UGT85C2 (SEQ ID NO: 7) | | | | 53380 | 4635 | 1775 | 85560 | 108620 | 100300 | | | |
| Substrate: Steviol No UGT85C2 | | | | | | | | | | 53745 | 46585 | 54250 |
| Substrate: 19-SMG No UGT85C2 | | | | 224605 | 206230 | 199490 | | | | | | |

Accumulation of 19-SMG and rubusoside was not observed in UGT85C2 variant activity assays using steviol as a substrate. Using steviol as the substrate, the F48H, F48Y, F48T, I49V, S84A, and L92F UGT85C2 variants demonstrated high activity during incubation periods of under 40 min, and the F48H, F48Y, F48T, and I49V UGT85C2 variants demonstrated high activity during incubation periods of over 40 min (Table 8A). Using 19-SMG as the substrate, the F48H, F48Y, F48T, I49V, and S84A UGT85C2 variants demonstrated high activity during incubation periods of under 40 min, and the F48H, I49V, S84A, S84V, L91K, and L92F UGT85C2 variants, as well as the wild-type UGT85C2, demonstrated high activity during incubation periods of over 40 min (Table 8B). Slow conversion of steviol and 19-SMG was observed for UGT85C2 I87H (Tables 8A and 8B).

13-SMG/rubusoside ratios were calculated for the UGT85C2 variants. A high 13-SMG/rubusoside ratio indicates preference of a UGT85C2 variant for steviol, whereas a low 13-SMG/rubusoside ratio indicates preference of a UGT85C2 variant for 19-SMG. The L91K, L91R, and L92F UGT85C2 variants demonstrated a high 13-SMG/rubusoside ratio, whereas the F48Y, F48T, P86G UGT85C2 variants demonstrated a low 13-SMG/rubusoside ratio.

Figure 5:
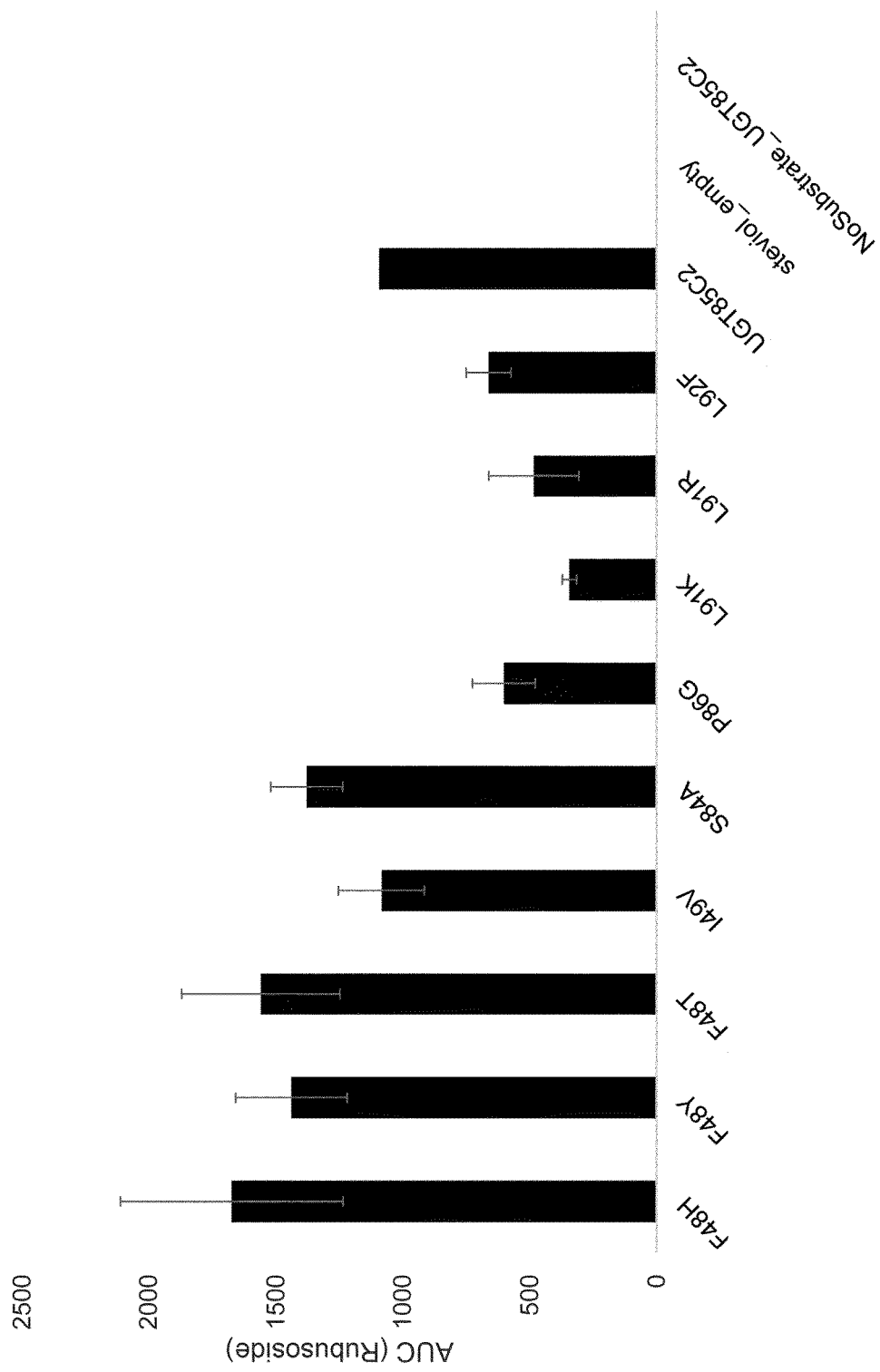
FIG. 5 shows conversion of steviol to rubusoside by bacterial lysates comprising UGT85C2 variants. Bacterial lysates were incubated with steviol for 24 h. See Example 7.

The UGT85C2 variants were found to convert steviol to rubusoside after 24 h. Rubusoside levels (in AUC) are shown in FIG. 5. Mutations in the amino acid 48 and 49 positions produced increased levels of rubusoside, as compared to the control. The variants with mutations in amino acids at position 86, 91 and 92 seem to produce lower levels of rubusoside.

Example 8: Evaluation of UGT76G1 Variants

UGT76G1 variants were tested in a modified version of a steviol glycoside-producing *S. cerevisiae* strain as described in Example 2 to determine the effects on steviol glycosides, tri-glycosylated ent-kaurenol, and tri-glycosylated ent-kaurenoic acid levels. The background strain was described in Example 9 of WO 2014/122227, wherein both copies of UGT76G1 were deleted by homologous recombination using selective markers. The strain comprised a reintegrated wild-type UGT76G1 (WT control) or variants of UGT76G1 at the chromosome level.

Expression of UGT76G1 H155L (SEQ ID NO:184) increased the ratio of RebM/RebD produced, as compared to wild-type UGT76G1. Expression of UGT76G1 Q23H (SEQ ID NO:181), UGT76G1 T146G (SEQ ID NO:183), UGT76G1 L257G (SEQ ID NO:185), or UGT76G1 S283N (SEQ ID NO:188) in the strain all resulted in increased accumulation of ent-kaurenoic acid+2Glc (#7), 1,2-bioside, 1,2-stevioside, RebE, RebD, steviol+5Glc (#22), and steviol+6Glc (isomer 1), increased the ratio of RebD/RebM produced, and decreased accumulation of RebB and RebA, as compared to wild-type UGT76G1. See Tables 9A-9C. Specifically, expression of UGT76G1 T146G (SEQ ID NO:183), resulted in increased accumulation of ent-kaurenoic acid+3Glc (isomer 1), steviol+3Glc (#1), and Stev3Glc (#34), as compared to wild-type UGT76G1. Expression of UGT76G1 L257G (SEQ ID NO:185) increased the amount of steviol+7Glc (isomer 2), as compared to wild-type UGT76G1. Expression of UGT76G1 S283N (SEQ ID NO:188) increased the amount of steviol+ 3Glc (#1) and Stev3Glc (#34), as compared to wild-type UGT76G1. See Tables 9A-9C.

TABLE 9A

Accumulation of steviol glycosides (in μM) in a host comprising wild-type UGT76G1 or a UGT76G1 variant.

|  | 13-SMG | 1,2-bioside | RebB | RebA | RebE | RebD | RebM |
|---|---|---|---|---|---|---|---|
| Wild-type (SEQ ID NO: 9) | 13.5 ± 3.8 | N/A | 1.5 ± 0.4 | 4.7 ± 1.9 | N/A | 5.2 ± 2.5 | 29.3 ± 15.5 |
| H155L (SEQ ID NO: 184) | 13.9 ± 2.4 | N/A | 1.8 ± 0.2 | 6.5 ± 1.5 | N/A | 2.1 ± 0.3 | 38.8 ± 12.6 |
| Q23H (SEQ ID NO: 181) | 13.4 ± 2.2 | 1.8 ± 0.4 | 0.9 ± 0.1 | 1.3 ± 0.2 | 4.6 ± 0.6 | 17.7 ± 6.4 | 1.9 ± 0.7 |
| T146G (SEQ ID NO: 183) | 13.9 ± 2.7 | 2.0 ± 0.4 | 0.6 ± 0.3 | 0.7 ± 0.5 | 7.4 ± 1.9 | 14.1 ± 3.5 | 1.1 ± 0.2 |
| L257G (SEQ ID NO: 185) | 13.6 ± 0.9 | 1.2 ± 0.1 | 0.9 ± 0.2 | 2.3 ± 0.3 | 2.8 ± 0.4 | 32.0 ± 6.1 | 7.0 ± 1.5 |
| S283N (SEQ ID NO: 188) | 13.5 ± 1.4 | 2.1 ± 0.4 | 0.5 ± 0.1 | 0.3 ± 0.5 | 7.9 ± 1.0 | 14.4 ± 3.9 | 0.9 ± 0.4 |
| Q23H + H155L (SEQ ID NO: 217) | 12.4 ± 1.1 | 1.4 ± 0.3 | 0.8 ± 0.1 | 1.9 ± 0.5 | 4.0 ± 0.4 | 22.4 ± 5.9 | 8.4 ± 3.4 |
| T146G + H155L (SEQ ID NO: 218) | 13.8 ± 1.3 | 1.4 ± 0.2 | 0.8 ± 0.1 | 2.2 ± 0.1 | 3.4 ± 0.4 | 26.5 ± 2.5 | 9.5 ± 1.9 |
| L257G + H155L (SEQ ID NO: 219) | 14.1 ± 1.3 | 0.9 ± 0.4 | 1.0 ± 0.1 | 3.1 ± 0.5 | 1.8 ± 0.5 | 23.8 ± 5.2 | 15.9 ± 1.5 |
| S283N + H155L (SEQ ID NO: 220) | 13.4 ± 2.6 | 2.3 ± 0.5 | 0.5 ± 0.3 | 0.3 ± 0.5 | 7.2 ± 1.8 | 10.1 ± 4.3 | 1.2 ± 0.6 |

TABLE 9B

Accumulation of steviol glycosides, glycosylated ent-kaurenoic acid, or glycosylated kaurenol (in AUC) in a host comprising wild-type UGT76G1 or a UGT76G1 variant.

|  | KA + 2Glc (#7) | KA + 3Glc (isomer 1) | KA + 3Glc (isomer 2) | KL + 2Glc (#8) | KL + 3Glc (isomer 1 and isomer 2) | 1,2-stevioside | steviol + 3Glc (#1) |
|---|---|---|---|---|---|---|---|
| Wild-type (SEQ ID NO: 9) | N/A | N/A | 859 ± 1089 | N/A | N/A | 887 ± 668 | N/A |
| H155L (SEQ ID NO: 184) | N/A | N/A | 1862 ± 1825 | N/A | 550 ± 1035 | 874 ± 754 | N/A |
| Q23H (SEQ ID NO: 181) | 3118 ± 1068 | 592 ± 1165 | N/A | N/A | N/A | 6716 ± 966 | 466 ± 500 |
| T146G (SEQ ID NO: 183) | 3109 ± 1441 | 1355 ± 951 | N/A | N/A | N/A | 8313 ± 1498 | 1243 ± 601 |
| L257G (SEQ ID NO: 185) | 2562 ± 1267 | 1062 ± 1199 | N/A | N/A | N/A | 5716 ± 837 | N/A |
| S283N (SEQ ID NO: 188) | 3872 ± 1086 | 1200 ± 1929 | N/A | N/A | N/A | 8572 ± 1325 | 1162 ± 644 |
| Q23H + H155L (SEQ ID NO: 217) | 2690 ± 423 | N/A | 236 ± 668 | N/A | N/A | 6690 ± 734 | 110 ± 311 |

TABLE 9B-continued

Accumulation of steviol glycosides, glycosylated ent-kaurenoic acid, or glycosylated kaurenol (in AUC) in a host comprising wild-type UGT76G1 or a UGT76G1 variant.

| | KA + 2Glc (#7) | KA + 3Glc (isomer 1) | KA + 3Glc (isomer 2) | KL + 2Glc (#8) | KL + 3Glc (isomer 1 and isomer 2) | 1,2-stevioside | steviol + 3Glc (#1) |
|---|---|---|---|---|---|---|---|
| T146G + H155L (SEQ ID NO: 218) | 2416 ± 555 | N/A | N/A | N/A | N/A | 6172 ± 524 | 208 ± 385 |
| L257G + H155L (SEQ ID NO: 219) | 1634 ± 1227 | 212 ± 600 | 1524 ± 1318 | N/A | 222 ± 628 | 5458 ± 1068 | N/A |
| S283N + H155L (SEQ ID NO: 220) | 3886 ± 750 | 496 ± 929 | N/A | 408 ± 1154 | N/A | 8036 ± 1601 | 1118 ± 614 |

KA: ent-kaurenoic acid
KL: ent-kaurenol

TABLE 9C

Accumulation of steviol glycosides (in AUC) in a host comprising wild-type UGT76G1 or a UGT76G1 variant.

| | steviol + 3Glc (#34) | steviol + 4Glc (#26) | steviol + 4Glc (#33) | steviol + 5Glc (#22) | steviol + 5Glc (#25) | steviol + 6Glc (isomer 1) | steviol + 7Glc (isomer 2) |
|---|---|---|---|---|---|---|---|
| Wild-type (SEQ ID NO: 9) | N/A | 2443 ± 1164 | N/A | N/A | N/A | N/A | N/A |
| H155L (SEQ ID NO: 184) | N/A | 1020 ± 731 | N/A | N/A | 938 ± 1039 | N/A | N/A |
| Q23H (SEQ ID NO: 181) | 472 ± 507 | 818 ± 726 | N/A | 19804 ± 4600 | N/A | 7350 ± 4013 | N/A |
| T146G (SEQ ID NO: 183) | 1262 ± 605 | 1509 ± 376 | 114 ± 302 | 38469 ± 8953 | N/A | 7365 ± 3483 | N/A |
| L257G (SEQ ID NO: 185) | 104 ± 294 | 1038 ± 459 | N/A | 11638 ± 2268 | N/A | 10722 ± 1871 | 3870 ± 2463 |
| S283N (SEQ ID NO: 188) | 1168 ± 655 | 1572 ± 625 | 104 ± 294 | 44460 ± 11455 | N/A | 12174 ± 5214 | N/A |
| Q23H + H155L (SEQ ID NO: 217) | 122 ± 345 | 964 ± 459 | N/A | 16600 ± 3617 | N/A | 4404 ± 2744 | 5230 ± 3262 |
| T146G + H155L (SEQ ID NO: 218) | 212 ± 383 | 1114 ± 192 | N/A | 14362 ± 1802 | N/A | 2498 ± 2743 | 4840 ± 2053 |
| L257G + H155L (SEQ ID NO: 219) | N/A | 782 ± 725 | N/A | 6354 ± 4578 | N/A | 2408 ± 2584 | 5780 ± 977 |
| S283N + H155L (SEQ ID NO: 220) | 1186 ± 673 | 1020 ± 739 | N/A | 38410 ± 17463 | N/A | 3864 ± 3520 | N/A |

The double UGT76G1 variants were also tested. The double variants were: UGT76G1 Q23H H155L (SEQ ID NO:217), UGT76G1 T146G H155L (SEQ ID NO:218), UGT76G1 L257G H155L (SEQ ID NO:219), and UGT76G1 S283N H155L (SEQ ID NO:220). Double variants UGT76G1 Q23H H155L (SEQ ID NO:217), UGT76G1 T146G H155L (SEQ ID NO:218), and UGT76G1 L257G H155L (SEQ ID NO:219) resulted in increased RebM accumulation, as compared to the three single variants UGT76G1 Q23H (SEQ ID NO:181), UGT76G1 T146G (SEQ ID NO:183), and UGT76G1 L257G (SEQ ID NO:185). See Tables 9A-9C. Specifically, expression of UGT76G1 Q23H H155L (SEQ ID NO:217) increased the amount of RebM and steviol+7Glc (isomer 2), compared to the UGT76G1 Q23H (SEQ ID NO:181) variant. Expression of UGT76G1 T146G H155L (SEQ ID NO:218) increased accumulation of RebA, RebD, RebM, and steviol+7Glc (isomer 2) and decreased accumulation of ent-kaurenoic acid+3Glc (isomer1), 1,2-bioside, 1,2-stevioside, steviol+3Glc (#1), Stev3Glc (#34), RebE, and steviol+5Glc (#22), as compared to the UGT76G1 T146G (SEQ ID NO:183) variant. Expression of UGT76G1 L257G H155L (SEQ ID NO:219) increased accumulation of ent-kaurenoic acid+ 3Glc (isomer 2), RebA, and RebM and decreased accumulation of RebE and steviol+6Glc (isomer 1), as compared to the UGT76G1 L257G (SEQ ID NO:185) variant. See Tables 9A-9C. Thus, synergistic effects were observed for UGT76G1 double variants.

UGT76G1 variants were also analyzed in a modified version of the strain described above, which comprised a higher copy number of UGT91D2e (SEQ ID NO:10, SEQ ID NO:11), UGT74G1 (SEQ ID NO:3, SEQ ID NO:4), and ATR2 (SEQ ID NO:91, SEQ ID NO:92). Steviol glycoside-producing S. cerevisiae strains expressing UGT76G1 variants that resulted in increased RebD levels, including UGT76G1 Q23H, UGT76G T146G, and S283N, also increased accumulation of ent-kaurenoic acid+2Glc (#7) and ent-kaurenoic acid+2Glc (isomer 1) but decreased accumulation of ent-kaurenoic acid+3Glc (isomer 2), compared to steviol glycoside-producing S. cerevisiae strains expressing wild-type UGT76G1. See FIG. 9A. UGT76G1 variants that increased RebD levels also increased accumulation of ent-kaurenol+2Glc (#8) but decreased accumulation of ent-kaurenol+3Glc (isomer 1) co-eluted with ent-kaurenol+3Glc (#6) (FIG. 9B).

Expression of the UGT76G1 H155L variant (SEQ ID NO:184), a variant that increased levels of RebM, resulted in decreased accumulation of ent-kaurenoic acid+2Glc (#7) and ent-kaurenoic acid+3Glc (isomer 1) (FIG. 9A). Levels of ent-kaurenol glycosides were not significantly altered upon expression of UGT76G1 variants that increased levels of RebM, compared to strains expressing wild-type UGT76G1 (FIG. 9B).

Figure 10B:
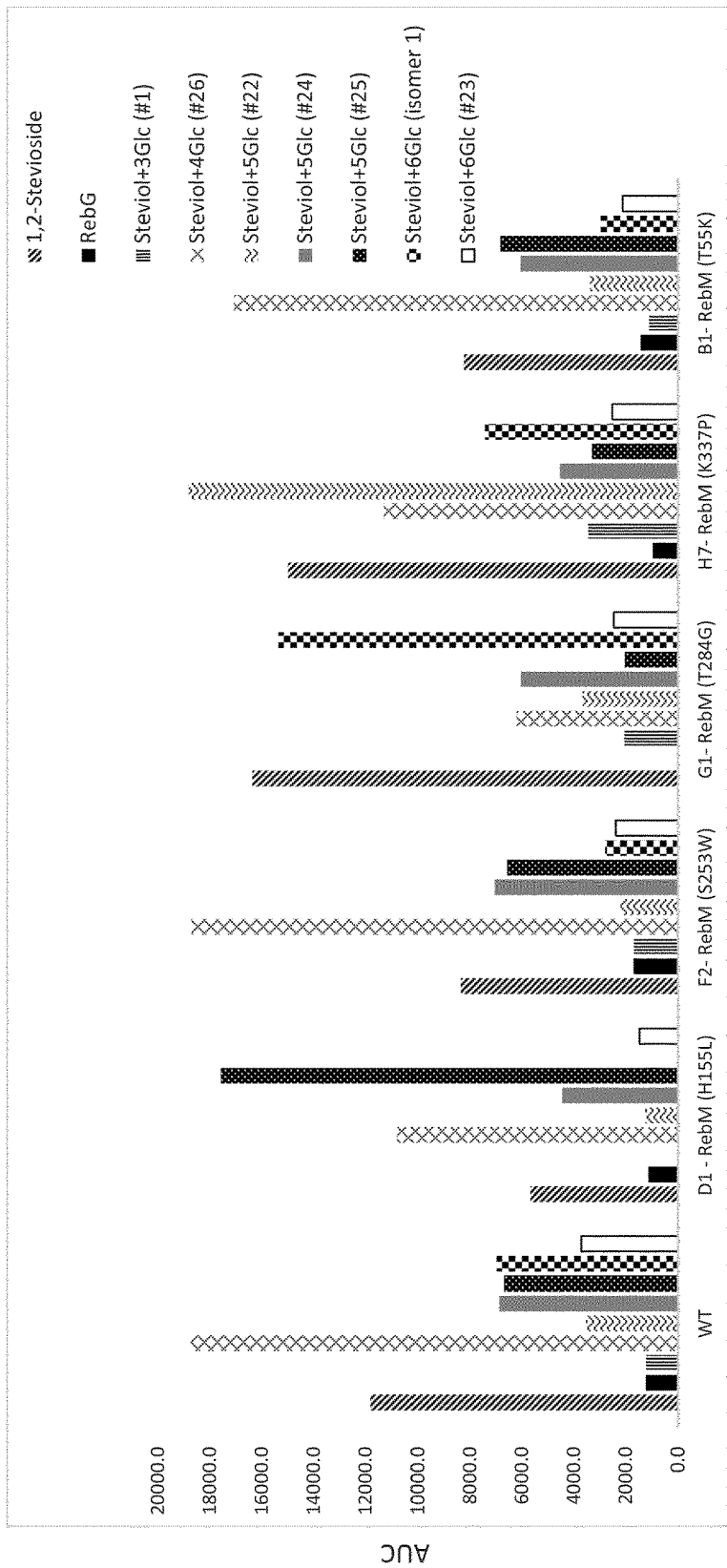
FIG. 10B shows accumulation of 1,2-stevioside, RebG, steviol+3Glc (#1), steviol+4Glc (#26), steviol+5Glc (#22), steviol+5Glc (#24), steviol+5Glc (#25), steviol+6Glc (isomer 1), and steviol+6Glc (#23) in S. cerevisiae expressing RebM-producing UGT76G1 variants.
Figure 10C:
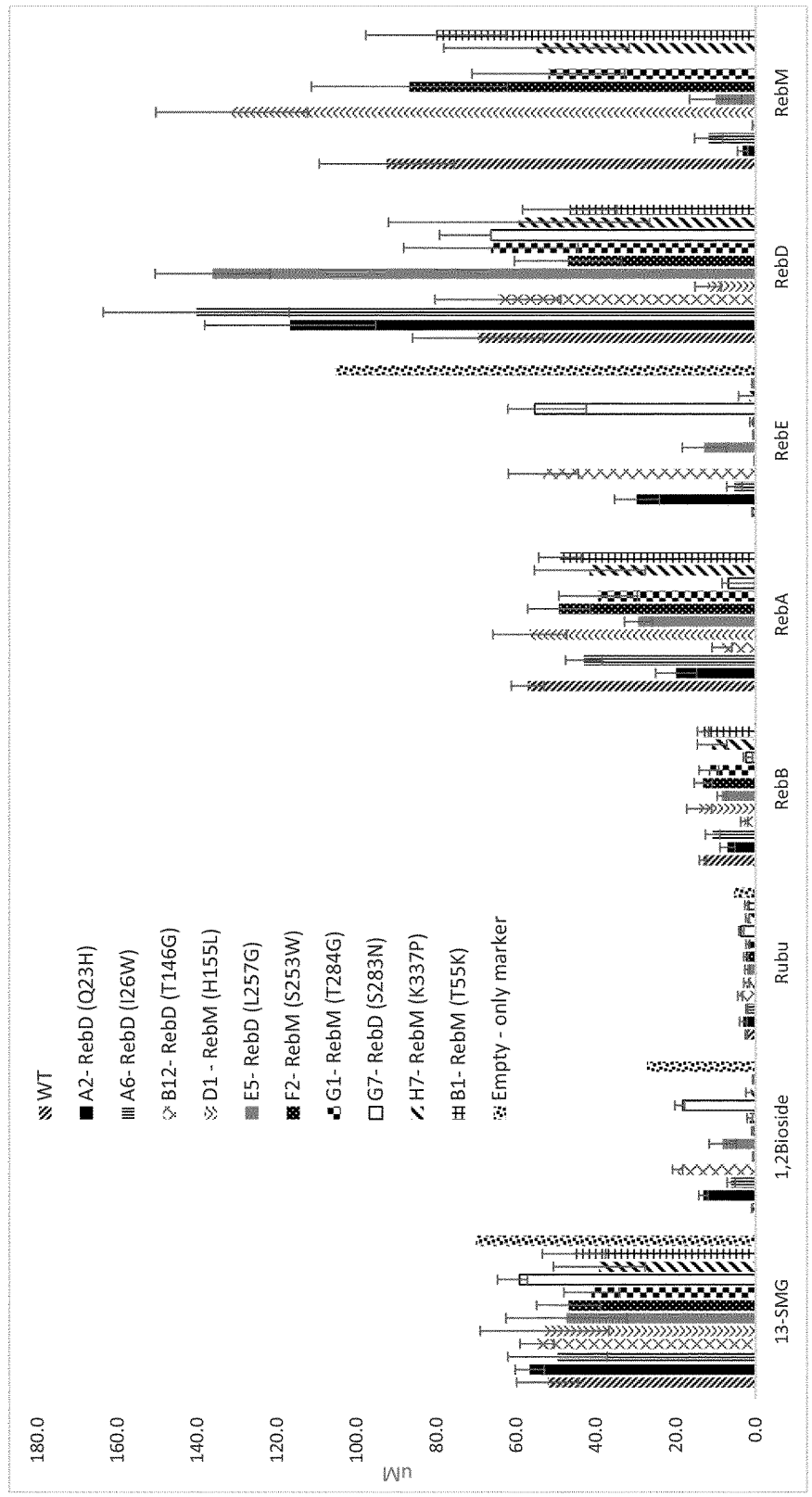
FIG. 10C shows accumulation of 13-SMG, 1,2-bioside, rubusoside, RebA, RebB, RebD, RebE, and RebM in S. cerevisiae expressing UGT76G1 variants. See Example 8.

Levels of 13-SMG, 1,2-bioside, rubusoside, RebA, RebB, RebD, RebE, RebM, RebG (1,3-stevioside), steviol+3Glc (#1), steviol+4Glc (#26), steviol+5Glc (#22), steviol+5Glc (#24), steviol+5Glc (#25), steviol+6Glc (isomer 1), and steviol+6Glc (#23) produced in the steviol glycoside-producing strain are shown in FIGS. 10A-10C. Expression of UGT variants that resulted in increased RebD levels also increased accumulation of steviol+5Glc (#22), 1,2-stevioside, steviol+6Glc (isomer 1), and Stevio+3Glc (#1) but decreased accumulation of steviol+4Glc (#26), steviol+5Glc (#24), and RebG (1,3-stevioside) (FIG. 10A). Expression of UGT76G1 H155L (SEQ ID NO:184) resulted in increased accumulation of steviol+5Glc (#25) but decreased accumulation of 1,2-stevioside, steviol+3Glc (#1), steviol+4Glc (#26), steviol+5Glc (#22), steviol+6Glc (isomer 1), and steviol+6Glc (#23) (FIG. 10B). Expression of UGT76G1 S253W (SEQ ID NO:186) resulted in decreased accumulation of 1,2-stevioside and steviol+6Glc (isomer 1) (FIG. 10B). Expression of UGT76G1 284G resulted in increased accumulation of 1,2-stevioside and steviol+6Glc (isomer 1) but decreased accumulation of RebG, steviol+4Glc (#26), steviol+5Glc (#25), and steviol+6Glc (#23) (FIG. 10B). FIG. 10O shows accumulation of 13-SMG, 1,2-bioside, rubusoside, RebA, RebB, RebD, RebE, and RebM in S. cerevisiae expressing wild-type UGT76G1 (SEQ ID NO:9) or a UGT76G1 variant that increases accumulation of RebD or RebM.

The steviol glycoside-producing strain comprising a higher copy number of UGT91D2e (SEQ ID NO:10, SEQ ID NO:11), UGT74G1 (SEQ ID NO:3, SEQ ID NO:4), and ATR2 (SEQ ID NO:91, SEQ ID NO:92) was further tested in a separate experiment. As shown in Tables 9D-9F, expression of UGT76G1 H155L (SEQ ID NO:184) resulted in increased accumulation of steviol+5Glc (#25), increased the ratio of RebM/RebD produced, and decreased accumulation of 1,2-bioside, steviol+3Glc (#1), RebE, steviol+6Glc (isomer 1), and steviol+6Glc (#23), as compared to wild-type UGT76G1. Expression of UGT76G1 Q23H (SEQ ID NO:181), UGT76G1 T146G (SEQ ID NO:183), UGT76G1 L257G (SEQ ID NO:185), or UGT76G1 S283N (SEQ ID NO:188) increased accumulation of 1,2-bioside, 1,2-stevioside, steviol+3Glc (#1), Stev+3Glc (#34), RebE, and steviol+5Glc (#22), increased the ratio of RebD/RebM produced, and decreased accumulation of RebG, RebA, steviol+5Glc (#25), steviol+7Glc (isomer 2), and steviol+7Glc (isomer 5). Specifically, expression of UGT76G1 Q23H (SEQ ID NO:181) resulted in increased accumulation of rubusoside, steviol+6Glc (isomer 1) and decreased accumulation of RebB and steviol+5Glc (#24). Expression of UGT76G1 T146G (SEQ ID NO:183) resulted in increased accumulation of rubusoside and decreased accumulation of RebB, steviol+5Glc (#24) and steviol+6Glc (#23). Expression of UGT76G1 L257G (SEQ ID NO:185) resulted in increased accumulation of steviol+6Glc (isomer 1). Expression of UGT76G1 S283N (SEQ ID NO:188) resulted in increased accumulation of rubusoside and decreased accumulation of RebB, steviol+5Glc (#24) and steviol+6Glc (#23). See Tables 9D-F.

TABLE 9D

Accumulation of steviol glycosides (in μM) in a host comprising wild-type UGT76G1 or a UGT76G1 variant.

|  | 13-SMG | 1,2-bioside | Rubu | RebG | RebB | RebA | RebE | RebD | RebM |
|---|---|---|---|---|---|---|---|---|---|
| Wild-type (SEQ ID NO: 9) | 37.6 ± 8.8 | 1.3 ± 0.5 | 1.2 ± 0.2 | 0.2 ± 0.2 | 8.4 ± 2.3 | 32.5 ± 7.5 | 0.4 ± 0.1 | 30.4 ± 12.5 | 43.0 ± 9.6 |
| H155L (SEQ ID NO: 184) | 35.3 ± 7.0 | 0.4 ± 0.1 | 1.3 ± 0.1 | 0.2 ± 0.2 | 8.9 ± 2.1 | 35.2 ± 9.3 | 0.1 ± 0.1 | 5.7 ± 1.8 | 64.5 ± 7.1 |
| Q23H (SEQ ID NO: 181) | 40.8 ± 6.9 | 11.1 ± 1.5 | 2.4 ± 0.4 | N/A | 4.3 ± 1.3 | 7.2 ± 2.0 | 11.8 ± 4.5 | 35.1 ± 6.5 | 1.0 ± 0.4 |
| T146G (SEQ ID NO: 183) | 41.4 ± 6.9 | 16.1 ± 1.4 | 3.1 ± 0.4 | N/A | 1.5 ± 0.5 | 2.4 ± 1.1 | 19.2 ± 3.2 | 15.0 ± 5.3 | 0.2 ± 0.2 |
| L257G (SEQ ID NO: 185) | 32.4 ± 6.2 | 6.9 ± 1.0 | 1.8 ± 0.5 | N/A | 5.2 ± 1.8 | 12.1 ± 4.8 | 4.7 ± 1.6 | 41.7 ± 10.4 | 2.3 ± 0.9 |
| S283N (SEQ ID NO: 188) | 39.8 ± 7.2 | 15.1 ± 2.8 | 2.6 ± 0.4 | N/A | 1.5 ± 0.5 | 2.9 ± 1.2 | 16.2 ± 4.8 | 19.2 ± 6.9 | 0.3 ± 0.1 |
| Q23H + H155L (SEQ ID NO: 217) | 39.4 ± 4.5 | 9.0 ± 1.3 | 2.1 ± 0.2 | N/A | 4.7 ± 0.9 | 8.3 ± 2.6 | 8.8 ± 1.6 | 34.1 ± 4.5 | 3.0 ± 1.2 |

TABLE 9D-continued

Accumulation of steviol glycosides (in μM) in a host comprising wild-type UGT76G1 or a UGT76G1 variant.

| | 13-SMG | 1,2-bioside | Rubu | RebG | RebB | RebA | RebE | RebD | RebM |
|---|---|---|---|---|---|---|---|---|---|
| T146G + H155L (SEQ ID NO: 218) | 33.0 ± 8.0 | 8.5 ± 2.0 | 1.9 ± 0.7 | N/A | 3.8 ± 1.0 | 9.2 ± 2.9 | 6.6 ± 1.7 | 36.5 ± 4.7 | 3.1 ± 0.9 |
| L257G + H155L (SEQ ID NO: 219) | 44.4 ± 6.6 | 4.9 ± 0.9 | 1.5 ± 0.3 | N/A | 8.2 ± 1.2 | 19.2 ± 4.0 | 3.4 ± 1.0 | 47.8 ± 4.5 | 12.3 ± 3.3 |
| S283N + H155L (SEQ ID NO: 220) | 42.9 ± 6.6 | 14.5 ± 1.1 | 2.8 ± 0.2 | N/A | 2.1 ± 0.7 | 2.7 ± 0.9 | 16.7 ± 1.9 | 17.2 ± 3.7 | 0.7 ± 0.3 |

TABLE 9E

Accumulation of steviol glycosides, glycosylated ent-kaurenoic acid, or glycosylated kaurenol (in AUC) in a host comprising wild-type UGT76G1 or a UGT76G1 variant.

| | KA + 2Glc (#7) | KA + 3Glc (isomer 1) | KA + 3Glc (isomer 2) | KL + 2Glc (#8) | KL + 3Glc (isomer 1 and isomer 2) |
|---|---|---|---|---|---|
| Wild-type (SEQ ID NO: 9) | 14444 ± 5537 | 2472 ± 1360 | 47650 ± 20783 | 8102 ± 4937 | 123288 ± 20872 |
| H155L (SEQ ID NO: 184) | 1096 ± 1570 | N/A | 48264 ± 17847 | 1770 ± 1118 | 105904 ± 33369 |
| Q23H (SEQ ID NO: 181) | 140332 ± 26599 | 10386 ± 2233 | 2914 ± 2162 | 183464 ± 22523 | 53058 ± 11295 |
| T146G (SEQ ID NO: 183) | 158245 ± 18966 | 7339 ± 2016 | N/A | 266539 ± 21693 | 21515 ± 3812 |
| L257G (SEQ ID NO: 185) | 111152 ± 39204 | 9732 ± 3604 | 7486 ± 3428 | 100144 ± 34855 | 67696 ± 22294 |
| S283N (SEQ ID NO: 188) | 149050 ± 55275 | 8722 ± 3756 | N/A | 222832 ± 63472 | 19864 ± 6586 |
| Q23H + H155L (SEQ ID NO: 217) | 107934 ± 18511 | 9230 ± 944 | 15348 ± 3586 | 86190 ± 13792 | 84080 ± 7629 |
| T146G + H155L (SEQ ID NO: 218) | 104146 ± 17815 | 9346 ± 1964 | 13674 ± 4859 | 98980 ± 30306 | 81762 ± 19834 |
| L257G + H155L (SEQ ID NO: 219) | 68986 + 17561 | 7974 ± 1665 | 34450 ± 6021 | 34730 ± 9050 | 99436 ± 7792 |
| S283N + H155L (SEQ ID NO: 220) | 146704 ± 15045 | 8168 ± 1243 | 1706 ± 1880 | 191804 ± 25165 | 31296 ± 6636 |

| | 19-SMG | 1,3-bioside | 1,2-stevioside | steviol + 3Glc (#1) | steviol + 3Glc (#34) |
|---|---|---|---|---|---|
| Wild-type (SEQ ID NO: 9) | 2174 ± 1054 | 274 ± 775 | 23410 ± 10331 | 2226 ± 1961 | 1512 + 2135 |
| H155L (SEQ ID NO: 184) | 2072 ± 940 | N/A | 13466 ± 2764 | N/A | N/A |
| Q23H (SEQ ID NO: 181) | 2364 ± 520 | N/A | 199500 ± 50824 | 21436 ± 6924 | 21436 ± 6924 |
| T146G (SEQ ID NO: 183) | 1961 ± 1049 | N/A | 237205 ± 38885 | 27438 ± 6704 | 27438 ± 6704 |

TABLE 9E-continued

Accumulation of steviol glycosides, glycosylated ent-kaurenoic acid, or glycosylated kaurenol (in AUC) in a host comprising wild-type UGT76G1 or a UGT76G1 variant.

| | | | | | |
|---|---|---|---|---|---|
| L257G (SEQ ID NO: 185) | 2010 ± 480 | N/A | 123746 ± 31888 | 13040 ± 2074 | 13070 ± 2086 |
| S283N (SEQ ID NO: 188) | 1980 ± 875 | N/A | 205128 ± 58796 | 28660 ± 10712 | 28660 ± 10712 |
| Q23H + H155L (SEQ ID NO: 217) | 2712 ± 674 | N/A | 162262 ± 12368 | 19104 ± 3180 | 19148 ± 3184 |
| T146G + H155L (SEQ ID NO: 218) | 2034 ± 768 | N/A | 138510 ± 32208 | 18846 ± 4723 | 18900 ± 4624 |
| L257G + H155L (SEQ ID NO: 219) | 2800 ± 1291 | N/A | 118750 ± 15972 | 10356 ± 1814 | 10376 ± 1838 |
| S283N + H155L (SEQ ID NO: 220) | 2694 ± 574 | N/A | 200156 ± 11694 | 25406 ± 6048 | 25406 ± 6048 |

KA: ent-kaurenoic acid

KL: ent-kaurenol

TABLE 9F

Accumulation of steviol glycosides (in AUC) in a host comprising wild-type UGT76G1 or a UGT76G1 variant.

| | steviol + 4Glc (#26) | steviol + 5Glc (#22) | steviol + 5Glc (#24) | steviol + 5Glc (#25) | steviol + 6Glc (isomer 1) |
|---|---|---|---|---|---|
| Wild-type (SEQ ID NO: 9) | 38936 ± 21188 | 3288 ± 3892 | 2194 ± 2020 | 9068 ± 3994 | 12294 ± 10105 |
| H155L (SEQ ID NO: 184) | 20000 ± 4629 | 178 ± 503 | 1530 ± 2310 | 29526 ± 15999 | 122 ± 345 |
| Q23H (SEQ ID NO: 181) | 26366 ± 7357 | 161044 ± 57250 | N/A | N/A | 26590 ± 3671 |
| T146G (SEQ ID NO: 183) | 25070 ± 6192 | 224315 ± 53331 | N/A | N/A | 10320 ± 3647 |
| L257G (SEQ ID NO: 185) | 17638 ± 5814 | 81252 ± 31941 | 258 ± 730 | N/A | 31616 ± 5164 |
| S283N (SEQ ID NO: 188) | 24980 ± 8098 | 219964 ± 61935 | N/A | N/A | 19666 ± 5418 |
| Q23H + H155L (SEQ ID NO: 217) | 23100 ± 2234 | 142460 ± 24407 | N/A | N/A | 15108 ± 1958 |
| T146G + H155L (SEQ ID NO: 218) | 19064 ± 3666 | 120990 ± 34224 | N/A | N/A | 13048 ± 2270 |
| L257G + H155L (SEQ ID NO: 219) | 17126 ± 2237 | 56416 ± 15937 | 928 ± 1293 | N/A | 17756 ± 2361 |
| S283N + H155L (SEQ ID NO: 220) | 23536 ± 2818 | 213846 ± 31505 | N/A | N/A | 11222 ± 2649 |

TABLE 9F-continued

Accumulation of steviol glycosides (in AUC) in a host comprising wild-type UGT76G1 or a UGT76G1 variant.

|  | steviol + 6Glc (#23) | steviol + 7Glc (isomer 2) | steviol + 7Glc (isomer 5) | Steviol |
|---|---|---|---|---|
| Wild-type (SEQ ID NO: 9) | 5838 ± 2979 | 13784 ± 4806 | 7630 ± 3054 | N/A |
| H155L (SEQ ID NO: 184) | 2000 ± 830 | 6494 ± 2530 | 10782 ± 2519 | N/A |
| Q23H (SEQ ID NO: 181) | 3108 ± 1514 | 2964 ± 1547 | 918 ± 1268 | N/A |
| T146G (SEQ ID NO: 183) | 304 ± 804 | 322 ± 853 | 286 ± 756 | N/A |
| L257G (SEQ ID NO: 185) | 5088 ± 1171 | 5154 ± 1398 | 1590 ± 1335 | 1246 ± 3524 |
| S283N (SEQ ID NO: 188) | 846 ± 1170 | 264 ± 747 | 296 ± 837 | N/A |
| Q23H + H155L (SEQ ID NO: 217) | 3582 ± 819 | 5996 ± 1705 | 596 ± 1121 | N/A |
| T146G + H155L (SEQ ID NO: 218) | 4288 ± 889 | 4640 ± 1866 | 1306 ± 1449 | N/A |
| L257G + H155L (SEQ ID NO: 219) | 5856 ± 960 | 15114 ± 1900 | 2230 ± 985 | N/A |
| S283N + H155L (SEQ ID NO: 220) | 1162 ± 1288 | 1042 ± 1117 | N/A | N/A |

Expression of UGT76G1 Q23H H155L (SEQ ID NO:217) increased accumulation of ent-kaurenoic acid+3Glc (isomer 2) and ent-kaurenol+3Glc (isomer 1) and decreased accumulation of ent-kaurenol+2Glc (#8) and steviol+6Glc (isomer 1), as compared to UGT76G1 Q23H (SEQ ID NO:181). UGT76G1 T146G H155L (SEQ ID NO:218) increased accumulation of ent-kaurenoic acid+3Glc (isomer 2), ent-kaurenol+3Glc (isomer 1), RebB, RebA, RebD, steviol+6Glc (#23), and steviol+7Glc (isomer 2) and decreased accumulation of ent-kaurenoic acid+2Glc (#7), ent-kaurenol+2Glc (#8), 1,2-bioside, rubusoside, 1,2-stevioside, RebE, steviol+5Glc (#22), as compared to UGT76G1 T146G (SEQ ID NO:183). Expression of UGT76G1 L257G H155L (SEQ ID NO:219) increased accumulation of ent-kaurenoic acid+3Glc (isomer 2), ent-kaurenol+3Glc (isomer 1), and steviol+7Glc (isomer 2) and decreased accumulation of ent-kaurenol+2Glc (#8), 1,2-bioside, and steviol+6Glc (isomer 1), as compared to UGT76G1 L257G (SEQ ID NO:185). As well, UGT76G1 L257G H155L (SEQ ID NO:219) increased accumulation of RebD, as compared to wild-type UGT76G1. Expression of UGT76G1 S283N H155L (SEQ ID NO:220) decreased accumulation of steviol+6Glc (isomer 1), as compared to UGT76G1 S283N (SEQ ID NO:188). See Tables 9D-F.

UGT76G1 variants were also expressed in a steviol glycoside-producing strain comprising an extra copy of CPR1 (SEQ ID NO:77, SEQ ID NO:78), an extra copy of SrKAHe1 (SEQ ID NO:93, SEQ ID NO:94), and an extra copy of a UGT76G1 (SEQ ID NO:8, SEQ ID NO:9) or a UGT76G1 variant. Accumulation of steviol glycosides, tri-glycosylated ent-kaurenol, and tri-glycosylated ent-kaurenoic acid levels were measured. See FIG. 11.

Figure 11A:
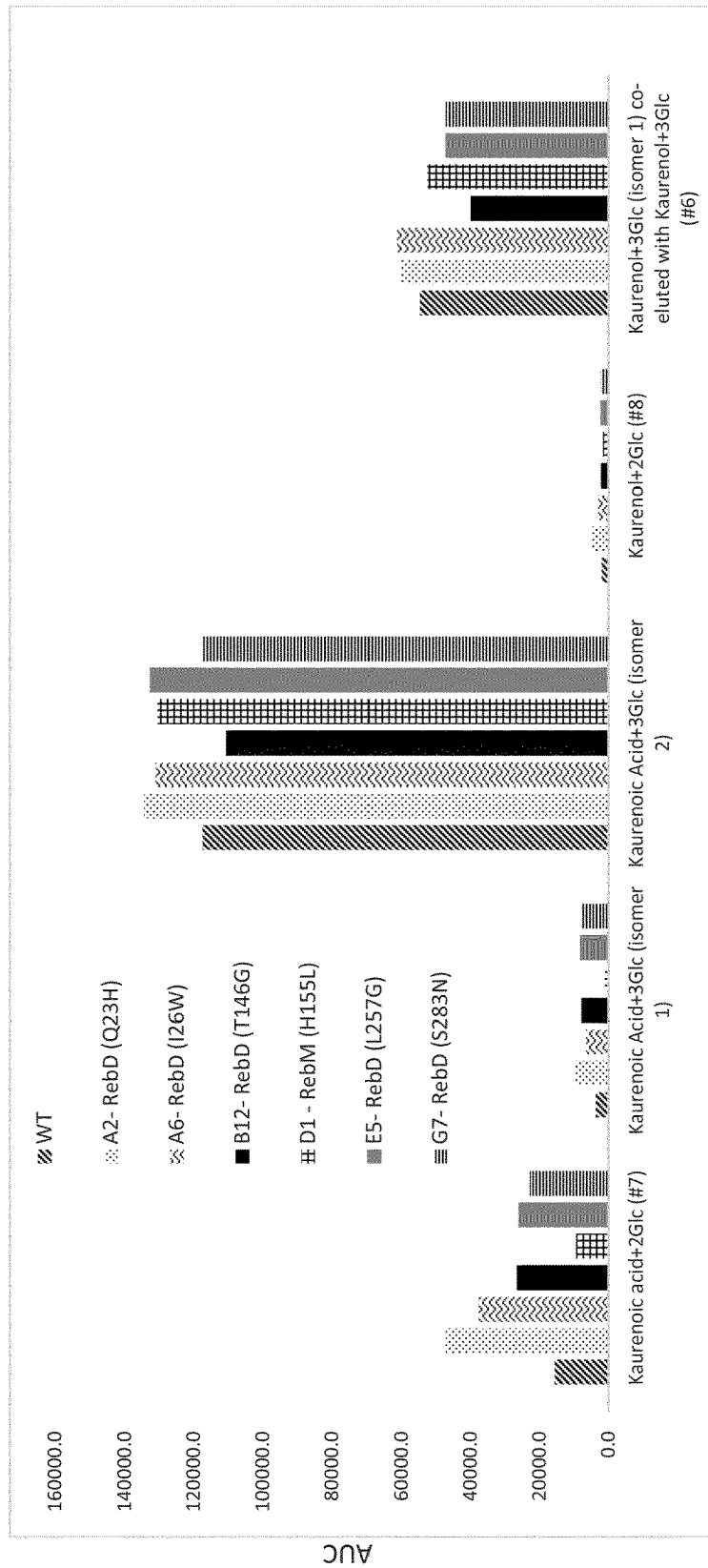
FIG. 11A shows accumulation of ent-kaurenoic acid+2Glc (#7), ent-kaurenoic acid+3Glc (isomer 1), ent-kaurenoic acid+3Glc (isomer 2), ent-kaurenol+2Glc (#8), and ent-kaurenol+3Glc (isomer 1) co-eluted with ent-kaurenol+3Glc (#6) in an S. cerevisiae steviol glycoside production strain (control strain comprised three copies of wild-type UGT76G1 (SEQ ID NO:9); variant strains comprised two copies of wild-type UGT76G1 and one copy of a UGT76G1 variant).
Figure 11B:
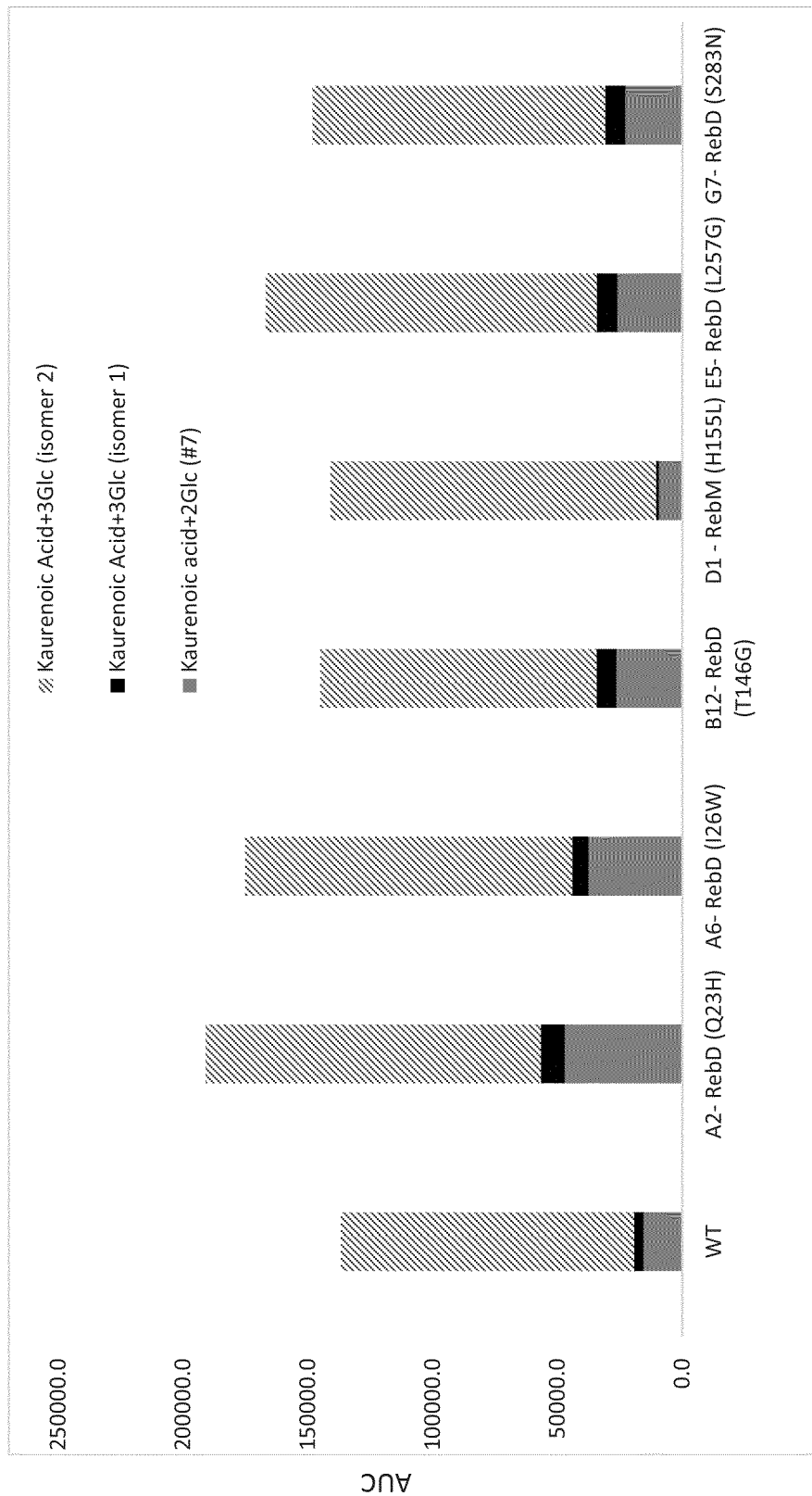
FIG. 11B shows total levels of glycosylated ent-kaurenoic acid (ent-kaurenoic acid+2Glc (#7)+ent-kaurenoic acid+3Glc (isomer 1)+ent-kaurenoic acid+3Glc (isomer 2)) in an S. cerevisiae steviol glycoside production strain expressing UGT76G1 variants.

UGT76G1 variants that increased accumulation of RebD or RebM were also expressed in a steviol glycoside production S. cerevisiae strain comprising an extra copy of CPR1 (SEQ ID NO:77, SEQ ID NO:78) and an extra copy of SrKAHe1 (SEQ ID NO:93, SEQ ID NO:94). The control steviol glycoside production strain comprised three copies of wild-type UGT76G1 (SEQ ID NO:9), and the variant-comprising strains comprised two copies of wild-type UGT76G1 (SEQ ID NO:9) and one copy of a UGT76G1 variant. FIG. 11A shows levels of ent-kaurenoic acid+2Glc (#7), ent-kaurenoic acid+3Glc (isomer 1), ent-kaurenoic acid+3Glc (isomer 2), ent-kaurenol+2Glc (#8), and ent-kaurenol+3Glc (isomer 1) co-eluted with ent-kaurenol+3Glc (#6) in production strains expressing wild-type UGT76G1 (SEQ ID NO:9), UGT76G1 Q23H (SEQ ID NO:181), UGT76G1 I26W (SEQ ID NO:182), UGT76G1 T146G (SEQ ID NO:183), UGT76G1 H155L (SEQ ID NO:184), UGT76G1 L257G (SEQ ID NO:185), or UGT76G1 S283N (SEQ ID NO:188). Total levels of glycosylated ent-kaurenoic acid (ent-kaurenoic acid+2Glc (#7)+ent-kaurenoic acid+3Glc (isomer 1)+ent-kaurenoic acid+3Glc (isomer 2)) were most significantly increased in production strains expressing UGT76G1 Q23H (SEQ ID NO:181), UGT76G1 I26W (SEQ ID NO:182), and UGT76G1 L257G (SEQ ID NO:185) (FIG. 11B), and total levels of glycosylated ent-kaurenol (ent-kaurenol+3Glc (isomer 1) co-eluted with ent-kaurenol+3Glc (#6) and ent-kaurenol+2Glc (#8) were most significantly affected for production strains expressing UGT76G1 Q23H (SEQ ID NO:181), UGT76G1 I26W (SEQ ID NO:182), and UGT76G1 T146G (SEQ ID NO:183) (FIG. 11O).

FIGS. 11D and 11E show accumulation of 1,2-bioside, 1,2-stevioside, steviol+3Glc (#1), steviol+4Glc (#26), steviol+5Glc (#22), steviol+5Glc (#24), steviol+5Glc (#25), steviol+6Glc (isomer 1), steviol+6Glc (#23), steviol+7Glc (isomer 2), steviol+7Glc (isomer 5), 13-SMG, rubusoside, RebG (1,3-stevioside), RebA, RebB, RebD, RebE, and RebM in production strains expressing wild-type UGT76G1 (SEQ ID NO:9), UGT76G1 Q23H (SEQ ID NO:181), UGT76G1 I26W (SEQ ID NO:182), UGT76G1 T146G (SEQ ID NO:183), UGT76G1 H155L (SEQ ID NO:184), UGT76G1 L257G (SEQ ID NO:185), or UGT76G1 S283N (SEQ ID NO:188).

All UGT76G1 variants tested in FIG. 11D showed decreased accumulation of steviol+4Glc (#26). Expression of UGT76G1 Q23H (SEQ ID NO:181), UGT76G1 I26W (SEQ ID NO:182), UGT76G1 T146G (SEQ ID NO:183), UGT76G1 L257G (SEQ ID NO:185), or UGT76G1 S283N (SEQ ID NO:188), all of which increased production of RebD, resulted in decreased accumulation of steviol+5Glc (#25), compared to a control strain expressing wild-type UGT76G1 (FIG. 11D). However, expression of the UGT76G1 H155L (SEQ ID NO:184) variant, which increased RebM production, resulted in increased accumulation of steviol+5Glc (#25) (FIG. 11D).

Expression of UGT76G1 Q23H (SEQ ID NO:181), UGT76G1 I26W (SEQ ID NO:182), UGT76G1 T146G (SEQ ID NO:183), UGT76G1 L257G (SEQ ID NO:185), or UGT76G1 S283N (SEQ ID NO:188) resulted in increased accumulation of steviol+6Glc (#23), compared to a control strain expressing wild-type UGT76G1, whereas expression of the UGT76G1 H155L (SEQ ID NO:184) variant resulted in decreased accumulation of steviol+6Glc (#23) (FIG. 11D). Expression of UGT76G1 Q23H (SEQ ID NO:181), UGT76G1 I26W (SEQ ID NO:182), UGT76G1 T146G (SEQ ID NO:183), UGT76G1 L257G (SEQ ID NO:185), or UGT76G1 S283N (SEQ ID NO:188) resulted in increased accumulation of steviol+7Glc (isomer 2), compared to a control strain expressing wild-type UGT76G1, whereas expression of the UGT76G1 H155L (SEQ ID NO:184) variant resulted in decreased accumulation of steviol+7Glc (isomer 2) (FIG. 11D). Expression of UGT76G1 Q23H (SEQ ID NO:181), UGT76G1 I26W (SEQ ID NO:182), UGT76G1 T146G (SEQ ID NO:183), UGT76G1 L257G (SEQ ID NO:185), or UGT76G1 S283N (SEQ ID NO:188) resulted in increased accumulation of steviol+7Glc (isomer 5) (FIG. 11D).

The steviol glycoside-producing strain comprising a higher copy number of CPR1 (SEQ ID NO:77, SEQ ID NO:78) and SrKAHe1 (SEQ ID NO:93, SEQ ID NO:94) was further tested in a separate experiment. As shown in Tables 9G-9I, expression of UGT76G1 H155L (SEQ ID NO:184) reduced the levels of ent-kaurenoic acid+3Glc (isomer 1), RebD, steviol+6Glc (#23), steviol+7Glc (isomer 2), as compared to wild-type UGT76G1. Expression of UGT76G1 Q23H (SEQ ID NO:181), UGT76G1 T146G (SEQ ID NO:183), UGT76G1 L257G (SEQ ID NO:185), or UGT76G1 S283N (SEQ ID NO:188) each reduced accumulation of steviol+4Glc (#26) and steviol+5Glc (#24), as compared to wild-type UGT76G1. Specifically, expression UGT76G1 T146G (SEQ ID NO:183) increased the amount of ent-kaurenoic acid+2Glc (#7), ent-kaurenoic acid+3Glc (isomer 1), RebD, steviol+6Glc (#23), and steviol+7Glc (isomer 2) and reduced the amount of RebG, steviol+5Glc #25, as compared to wild-type UGT76G1. Expression of UGT76G1 L257G (SEQ ID NO:185) increased accumulation of ent-kaurenoic acid+3Glc (isomer 1) and reduced accumulation of ent-kaurenoic acid+3Glc (isomer 2) and steviol+5Glc (#25), as compared to wild-type UGT76G1. Expression of UGT76G1 S283N (SEQ ID NO:188) increased accumulation of ent-kaurenoic acid+3Glc (isomer 1), RebD, steviol+6Glc (isomer 1), and steviol+7Glc (isomer 2) and reduced accumulation of RebG and steviol+5G1 (#25), as compared to wild-type UGT76G1. Expression of UGT76G1 L257G H155L reduced accumulation of ent-kaurenoic acid+3Glc (isomer 1), as compared to the single variant UGT76G1 L257G. Expression of the double variant UGT76G1 Q23H H155L reduced accumulation of steviol+5Glc (#25), as compared to wild-type UGT76G1. Expression of the double variant UGT76G1 S283N H155L reduced accumulation of ent-kaurenoic acid+3Glc (isomer 2), as compared to wild-type UGT76G1. See Tables 9G-9I.

TABLE 9G

Accumulation of steviol glycosides (in μM) in a host comprising wild-type UGT76G1 or a UGT76G1 variant.

| | 13-SMG | 1,2-bioside | Rubu | RebG | RebB | RebA | RebE | RebD | RebM |
|---|---|---|---|---|---|---|---|---|---|
| Wild-type (SEQ ID NO: 9) | 66.9 ± 4.7 | 0.4 ± 0.1 | 1.2 ± 0.2 | 0.7 ± 0.3 | 5.6 ± 0.4 | 30.3 ± 2.4 | 0.5 ± 0.4 | 31.0 ± 6.7 | 199.3 ± 14.2 |
| H155L (SEQ ID NO: 184) | 63.1 ± 4.6 | 0.3 ± 0.1 | 1.3 ± 0.3 | 0.9 ± 0.3 | 5.5 ± 0.5 | 29.6 ± 1.9 | 0.1 ± 0.2 | 12.0 ± 10.8 | 210.0 ± 19.3 |
| Q23H (SEQ ID NO: 181) | 62.2 ± 13.9 | 0.4 ± 0.1 | 0.8 ± 0.3 | 0.2 ± 0.3 | 5.2 ± 0.9 | 27.7 ± 3.3 | 0.6 ± 0.2 | 42.0 ± 9.8 | 179.2 ± 19.6 |
| T146G (SEQ ID NO: 183) | 64.8 ± 5.2 | 0.5 ± 0.2 | 1.0 ± 0.1 | 0.1 ± 0.2 | 5.3 ± 0.8 | 27.9 ± 3.1 | 0.8 ± 0.1 | 46.2 ± 6.7 | 180.4 ± 24.2 |
| L257G (SEQ ID NO: 185) | 68.7 ± 9.2 | 0.4 ± 0.1 | 0.6 ± 0.4 | 0.2 ± 0.3 | 5.5 ± 0.6 | 29.6 ± 3.4 | 0.6 ± 0.4 | 45.6 ± 9.3 | 187.3 ± 14.7 |
| S283N (SEQ ID NO: 188) | 67.4 ± 13.3 | 0.4 ± 0.1 | 0.7 ± 0.5 | 0.1 ± 0.2 | 5.7 ± 0.7 | 32.0 ± 4.2 | 0.8 ± 0.4 | 52.7 ± 7.4 | 189.2 ± 14.1 |
| Q23H + H155L (SEQ ID NO: 217) | 65.2 ± 4.3 | 0.3 ± 0.0 | 0.8 ± 0.4 | 0.3 ± 0.3 | 5.3 ± 0.3 | 27.1 ± 2.8 | 0.7 ± 0.3 | 37.5 ± 5.4 | 187.5 ± 10.8 |
| T146G + H155L (SEQ ID NO: 218) | 64.3 ± 9.8 | 0.5 ± 0.1 | 0.8 ± 0.3 | 0.1 ± 0.2 | 5.4 ± 0.6 | 27.3 ± 4.3 | 0.7 ± 0.4 | 40.0 ± 8.7 | 171.2 ± 29.8 |

TABLE 9G-continued

Accumulation of steviol glycosides (in μM) in a host comprising wild-type UGT76G1 or a UGT76G1 variant.

| | 13-SMG | 1,2-bioside | Rubu | RebG | RebB | RebA | RebE | RebD | RebM |
|---|---|---|---|---|---|---|---|---|---|
| L257G + H155L (SEQ ID NO: 219) | 58.5 ± 15.9 | 0.3 ± 0.1 | 0.5 ± 0.5 | 0.3 ± 0.3 | 5.2 ± 1.5 | 25.1 ± 7.9 | 0.7 ± 0.3 | 30.4 ± 13.3 | 167.6 ± 33.6 |
| S283N + H155L (SEQ ID NO: 220) | 61.2 ± 11.8 | 0.4 ± 0.1 | 0.6 ± 0.5 | 0.0 ± 0.0 | 5.2 ± 1.0 | 25.0 ± 5.5 | 0.6 ± 0.5 | 37.5 ± 12.0 | 152.5 ± 35.2 |

TABLE 9H

Accumulation of steviol glycosides, glycosylated ent-kaurenoic acid, or glycosylated kaurenol (in AUC) in a host comprising wild-type UGT76G1 or a UGT76G1 variant.

| | KA + 2Glc (#7) | KA + 3Glc (isomer 1) | KA + 3Glc (isomer 2) | KL + 3Glc (isomer 1 and isomer 2) | 19-SMG | 1,2-stevioside | RebI | steviol + 4Glc (#26) |
|---|---|---|---|---|---|---|---|---|
| Wild-type (SEQ ID NO: 9) | 2422 ± 419 | 1962 ± 383 | 40290 ± 3139 | 11500 ± 1169 | 422 ± 270 | 4712 ± 656 | N/A | 11194 ± 2466 |
| H155L (SEQ ID NO: 184) | 2894 ± 401 | 418 ± 841 | 40350 ± 2392 | 10326 ± 759 | 376 ± 316 | 4466 ± 359 | 512 ± 992 | 9086 ± 1374 |
| Q23H (SEQ ID NO: 181) | 3340 ± 1018 | 3044 ± 747 | 41140 ± 5158 | 11404 ± 1306 | 476 ± 317 | 4452 ± 595 | N/A | 6550 ± 771 |
| T146G (SEQ ID NO: 183) | 3362 ± 509 | 2934 ± 399 | 40636 ± 5193 | 10880 ± 872 | 400 ± 350 | 4600 ± 511 | N/A | 6996 ± 695 |
| L257G (SEQ ID NO: 185) | 2816 ± 240 | 2712 ± 264 | 34402 ± 2377 | 10820 ± 708 | 254 ± 272 | 4770 ± 642 | N/A | 5884 ± 674 |
| S283N (SEQ ID NO: 188) | 3114 ± 585 | 2914 ± 346 | 35830 ± 2929 | 11430 ± 641 | 188 ± 348 | 4986 ± 562 | N/A | 5734 ± 442 |
| Q23H + H155L (SEQ ID NO: 217) | 2622 ± 286 | 2250 ± 408 | 37176 ± 3860 | 10376 ± 1049 | 264 ± 283 | 4404 ± 416 | N/A | 6036 ± 906 |
| T146G + H155L (SEQ ID NO: 218) | 2884 ± 354 | 2424 ± 324 | 34100 ± 5312 | 10026 ± 1326 | 248 ± 347 | 4438 ± 1060 | N/A | 5836 ± 10777 |
| L257G + H155L (SEQ ID NO: 219) | 2364 ± 691 | 1798 ± 368 | 32044 ± 5509 | 9472 ± 1812 | 256 ± 363 | 3690 ± 1217 | N/A | 5254 ± 1189 |
| S283N + H155L (SEQ ID NO: 220) | 3162 ± 1250 | 2656 ± 980 | 31504 ± 4414 | 9386 ± 1425 | 384 ± 331 | 4014 ± 925 | N/A | 5638 ± 1696 |

KA: ent-kaurenoic acid
KL: ent-kaurenol

TABLE 9I

Accumulation of steviol glycosides (in AUC) in a host comprising wild-type UGT76G1 or a UGT76G1 variant.

| | steviol + 4Glc (#33) | steviol + 5Glc (#22) | steviol + 5Glc (#24) | steviol + 5Glc (#25) | steviol + 6Glc (isomer 1) | steviol + 6Glc (#23) | steviol + 7Glc (isomer 2) | steviol + 7Glc (isomer 5) |
|---|---|---|---|---|---|---|---|---|
| Wild-type (SEQ ID NO: 9) | N/A | N/A | 7416 ± 1103 | 5230 ± 789 | 1572 ± 1044 | 3622 ± 590 | 7078 ± 912 | 4474 ± 2521 |
| H155L (SEQ ID NO: 184) | 122 ± 345 | N/A | 7452 ± 2166 | 9450 ± 4068 | 320 ± 905 | 1868 ± 825 | 3894 ± 1243 | 4760 ± 1318 |
| Q23H (SEQ ID NO: 181) | N/A | 108 ± 305 | 4382 ± 1490 | 3412 ± 1176 | 2792 ± 1053 | 4520 ± 985 | 9388 ± 1677 | 4158 ± 1528 |

TABLE 9I-continued

Accumulation of steviol glycosides (in AUC) in a host comprising wild-type UGT76G1 or a UGT76G1 variant.

| | steviol + 4Glc (#33) | steviol + 5Glc (#22) | steviol + 5Glc (#24) | steviol + 5Glc (#25) | steviol + 6Glc (isomer 1) | steviol + 6Glc (#23) | steviol + 7Glc (isomer 2) | steviol + 7Glc (isomer 5) |
|---|---|---|---|---|---|---|---|---|
| T146G (SEQ ID NO: 183) | N/A | 114 ± 322 | 3598 ± 1630 | 2996 ± 745 | 3356 ± 1047 | 5438 ± 636 | 10406 ± 910 | 3700 ± 1726 |
| L257G (SEQ ID NO: 185) | N/A | N/A | 4336 ± 1158 | 3484 ± 754 | 2860 ± 842 | 4158 ± 1149 | 9348 ± 1429 | 4420 ± 1036 |
| S283N (SEQ ID NO: 188) | N/A | N/A | 4834 ± 1338 | 3358 ± 546 | 3566 ± 784 | 4350 ± 909 | 9796 ± 1619 | 3924 ± 1203 |
| Q23H + H155L (SEQ ID NO: 217) | N/A | N/A | 4468 ± 1172 | 3668 ± 679 | 1932 ± 380 | 3798 ± 619 | 8764 ± 1384 | 3528 ± 2244 |
| T146G + H155L (SEQ ID NO: 218) | N/A | N/A | 3682 ± 1715 | 3008 ± 775 | 2176 ± 698 | 4022 ± 898 | 8712 ± 879 | 3284 ± 1803 |
| L257G + H155L (SEQ ID NO: 219) | N/A | N/A | 3566 ± 1693 | 2974 ± 781 | 956 ± 1073 | 2988 ± 772 | 7046 ± 1660 | 3072 ± 1631 |
| S283N + H155L (SEQ ID NO: 220) | N/A | N/A | 2670 ± 1807 | 2554 ± 444 | 2430 ± 1647 | 3874 ± 1837 | 9450 ± 3268 | 2758 ± 1204 |

Example 9: Further Characterization of UGT76G1 H155L Variant

Figure 6A:
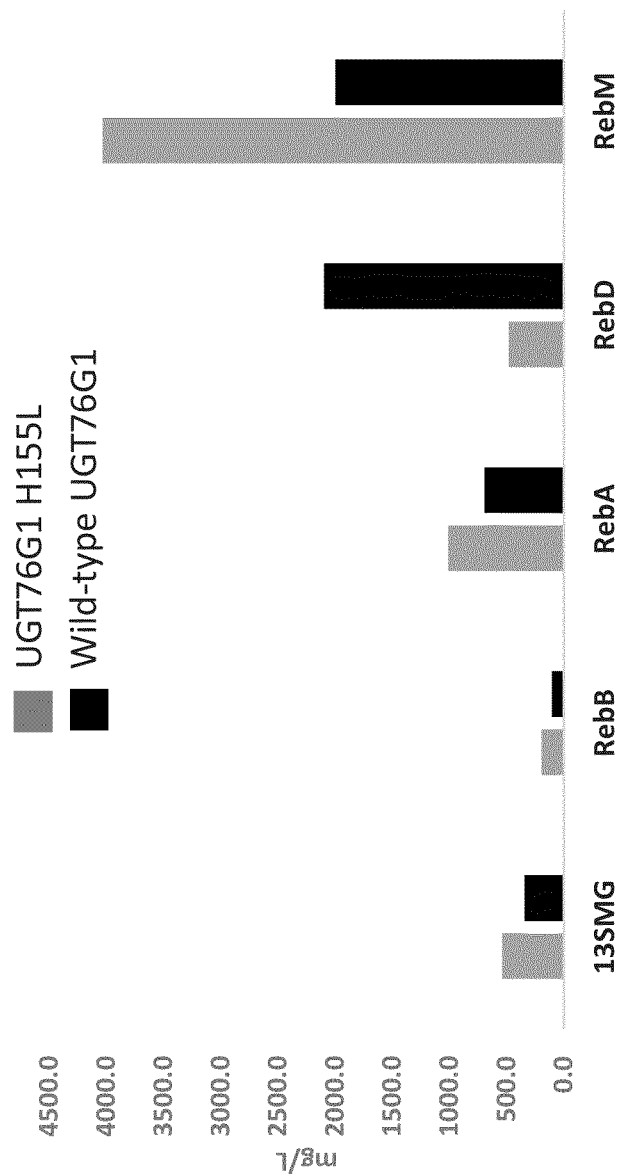
FIG. 6A shows production of RebM, RebD, RebA, RebB, 13-SMG, and rubusoside in a steviol glycoside-producing strain expressing UGT76G1 H155L (gray bars), compared to the control steviol glycoside-producing strain expressing wild-type UGT76G1 (black bars).

UGT76G1 H155L (SEQ ID NO:184) was expressed in the steviol glycoside-producing S. cerevisiae strain described in Examples 2 and 8. As shown in FIG. 6A, the strain expressing UGT76G1 H155L (gray bars) produced higher levels of RebM, RebA, RebB, 13-SMG, and rubusoside, compared to the control strain expressing wild-type UGT76G1 (black bars). The steviol glycoside-producing strain expressing UGT76G1 H155L produced higher titers of RebM than RebD (FIG. 6A).

The strain expressing UGT76G1 H155L (SEQ ID NO:184) produced greater total levels of steviol glycosides (13-SMG+1,2-bioside+rubusoside+RebG+RebB+RebA+ RebE+RebD+RebM) and RebD+RebM (gray bars), compared to the control strain expressing wild-type UGT76G1 (black bars) (FIG. 6B). Thus, the steviol glycoside-producing strain expressing UGT76G1 H155L (gray bars) demonstrated a 20% increase in steviol glycoside production and a 10% increase in RebD and RebM titers, compared to the control strain expressing wild-type UGT76G1 (black bars) (FIG. 6C).

The strain expressing UGT76G1 H155L (gray bars) also produced lesser amounts of a 1,2-bioside, 1,2-stevioside, a tri-glycosylated steviol molecule (steviol+3Glc (#1)), a penta-glycosylated steviol molecule (steviol+5Glc (#22), two hexa-glycosylated steviol molecules (steviol+6Glc (isomer 1 and #23)), and a hepta-glycosylated steviol molecule (steviol+7Glc (isomer 2)) but increased amounts of a tetra-glycosylated molecule (steviol+4Glc (#26)) and two penta-glycosylated steviol molecules (Steviol+5Glc (#24 and #25)), compared to the control strain expressing wild-type UGT76G1 (black bars) (FIG. 6D). See FIGS. 1, 7, and 8 for structures of particular steviol glycosides detected.

Having described the invention in detail and by reference to specific embodiments thereof, it will be apparent that modifications and variations are possible without departing from the scope of the invention defined in the appended claims. More specifically, although some aspects of the present invention are identified herein as particularly advantageous, it is contemplated that the present invention is not necessarily limited to these particular aspects of the invention.

TABLE 10

Sequences disclosed herein.

SEQ ID NO: 1

| | | | | | |
|---|---|---|---|---|---|
| MATSDSIVDD | RKQLHVATFP | WLAFGHILPY | LQLSKLIAEK | GHKVSFLSTT | RNIQRLSSHI | 60 |
| SPLINVVQLT | LPRVQELPED | AEATTDVHPE | DIPYLKKASD | GLQPEVTRFL | EQHSPDWIIY | 120 |
| DYTHYWLPSI | AASLGISRAH | FSVTTPWAIA | YMGPSADAMI | NGSDGRTTVE | DLTTPPKWFP | 180 |
| FPTKVCWRKH | DLARLVPYKA | PGISDGYRMG | LVLKGSDCLL | SKCYHEFGTQ | WLPLLETLHQ | 240 |
| VPVVPVGLLP | PEIPGDEKDE | TWVSIKKWLD | GKQKGSVVYV | ALGSECLVSQ | TEVVELALGL | 300 |
| ELSGLPFVWA | YRKPKGPAKS | DSVELPDGFV | ERTRDRGLVW | TSWAPQLRIL | SHESVCGFLT | 360 |
| HCGSGSIVEG | LMFGHPLIML | PIFGDQPLNA | RLLEDKQVGI | EIPRNEEDGC | LTKESVARSL | 420 |
| RSVVVEKEGE | IYKANARELS | KIYNDTKVEK | EYVSQFVDYL | EKNARAVAID | HES | 473 |

TABLE 10-continued

Sequences disclosed herein.

SEQ ID NO: 2

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWLPSI | AASLGISRAH | FSVTTPWAIA | YMGPSADAMI | NGSDGRTTVE | DLTTPPKWFP | 180
| FPTKVCWRKH | DLARLVPYKA | PGISDGYRMG | LVLKGSDCLL | SKCYHEFGTQ | WLPLLETLHQ | 240
| VPVVPVGLLP | PEIPGDEKDE | TWVSIKKWLD | GKQKGSVVYV | ALGSEVLVSQ | TEVVELALGL | 300
| ELSGLPFVWA | YRKPKGPAKS | DSVELPDGFV | ERTRDRGLVW | TSWAPQLRIL | SHESVCGFLT | 360
| HCGSGSIVEG | LMFGHPLIML | PIFWDQPLNA | RLLEDKQVGI | EIPRNEEDGC | LTKESVARSL | 420
| RSVVVEKEGE | IYKANARELS | KIYNDTKVEK | EYVSQFVDYL | EKNARAVAID | HES | 473

SEQ ID NO: 3

| | | | | | |
|---|---|---|---|---|---|
| atggcagagc | aacaaaagat | caaaaagtca | cctcacgtct | tacttattcc | atttcctctg | 60
| caaggacata | tcaacccatt | catacaattt | gggaaaagat | tgattagtaa | gggtgtaaag | 120
| acaacactgg | taaccactat | ccacactttg | aattctactc | tgaaccactc | aaatactact | 180
| actacaagta | tagaaattca | agctatatca | gacggatgcg | atgagggtgg | ctttatgtct | 240
| gccggtgaat | cttacttgga | aacattcaag | caagtgggat | ccaagtctct | ggccgatcta | 300
| atcaaaaagt | tacagagtga | aggcaccaca | attgacgcca | taatctacga | ttctatgaca | 360
| gagtgggttt | tagacgttgc | tatcgaattt | ggtattgatg | gaggttcctt | tttcacacaa | 420
| gcatgtgttg | tgaattctct | atactaccat | gtgcataaag | ggtaatctc | tttaccattg | 480
| ggtgaaactg | tttcagttcc | aggttttcca | gtgttacaac | gttgggaaac | cccattgatc | 540
| ttacaaaatc | atgaacaaat | acaatcacct | tggtcccaga | tgttgtttgg | tcaattcgct | 600
| aacatcgatc | aagcaagatg | ggtctttact | aattcattct | ataagttaga | ggaagaggta | 660
| attgaatgga | ctaggaagat | ctggaatttg | aaagtcattg | gtccaacatt | gccatcaatg | 720
| tatttggaca | aaagacttga | tgatgataaa | gataatggtt | tcaatttgta | caaggctaat | 780
| catcacgaat | gtatgaattg | gctggatgac | aaaccaaagg | aatcagttgt | atatgttgct | 840
| ttcggctctc | ttgttaaaca | tggtccagaa | caagttgagg | agattacaag | agcacttata | 900
| gactctgacg | taaactttt | gtgggtcatt | aagcacaaag | aggaggggaa | actgccagaa | 960
| aacctttctg | aagtgataaa | gaccggaaaa | ggtctaatcg | ttgcttggtg | taaacaattg | 1020
| gatgttttag | ctcatgaatc | tgtaggctgt | tttgtaacac | attgcggatt | caactctaca | 1080
| ctagaagcca | tttccttagg | cgtacctgtc | gttgcaatgc | ctcagttctc | cgatcagaca | 1140
| accaacgcta | aacttttgga | cgaaatacta | ggggtgggtg | tcagagttaa | agcagacgag | 1200
| aatggtatcg | tcagaagagg | gaacctagct | tcatgtatca | aaatgatcat | ggaagaggaa | 1260
| agaggagtta | tcataaggaa | aaacgcagtt | aagtggaagg | atcttgcaaa | ggttgccgtc | 1320
| catgaaggcg | gctcttcaga | taatgatatt | gttgaatttg | tgtccgaact | aatcaaagcc | 1380
| taa | | | | | | 1383

SEQ ID NO: 4

| | | | | | |
|---|---|---|---|---|---|
| MAEQQKIKKS | PHVLLIPFPL | QGHINPFIQF | GKRLISKGVK | TTLVTTIHTL | NSTLNHSNTT | 60
| TTSIEIQAIS | DGCDEGGFMS | AGESYLETFK | QVGSKSLADL | IKKLQSEGTT | IDAIIYDSMT | 120
| EWVLDVAIEF | GIDGGSFFTQ | ACVVNSLYYH | VHKGLISLPL | GETVSVPGFP | VLQRWETPLI | 180
| LQNHEQIQSP | WSQMLFGQFA | NIDQARWVFT | NSFYKLEEEV | IEWTRKIWNL | KVIGPTLPSM | 240
| YLDKRLDDDK | DNGFNLYKAN | HHECMNWLDD | KPKESVVYVA | FGSLVKHGPE | QVEEITRALI | 300
| DSDVNFLWVI | KHKEEGKLPE | NLSEVIKTGK | GLIVAWCKQL | DVLAHESVGC | FVTHCGFNST | 360
| LEAISLGPVV | VAMPQFSDQT | TNAKLLDEIL | GVGVRVKADE | NGIVRRGNLA | SCIKMIMEEE | 420
| RGVIIRKNAV | KWKDLAKVAV | HEGGSSDNDI | VEFVSELIKA | | | 460

SEQ ID NO: 5

| | | | | | |
|---|---|---|---|---|---|
| atggatgcaa | tggctacaac | tgagaagaaa | ccacacgtca | tcttcatacc | atttccagca | 60
| caaagccaca | ttaaagccat | gctcaaacta | gcacaacttc | tccaccacaa | aggactccag | 120
| ataaccttcg | tcaacaccga | cttcatccac | aaccagtttc | ttgaatcatc | gggcccacat | 180
| tgtctagacg | tgtcaccggg | tttccggttc | gaaaccattc | cggatggtgt | ttctcacagt | 240
| ccggaagcga | gcatcccaat | cagagaatca | ctcttgagat | ccattgaaac | caacttcttg | 300
| gatcgtttca | ttgatcttgt | aaccaaactt | ccggatcctc | cgacttgtat | tatctcagat | 360
| gggttcttgt | cggttttcac | aattgacgct | gcaaaaaagc | ttggaattcc | ggtcatgatg | 420
| tattggacac | ttgctgcctg | tgggttcatg | gttttttacc | atattcattc | tctcattgag | 480
| aaaggatttg | caccacttaa | agatgcaagt | tacttgacaa | atgggtattt | ggacaccgtc | 540
| attgattggg | ttccgggaat | ggaaggcatc | cgtctcaagg | atttcccgct | ggactggagc | 600
| actgacctca | atgacaaagt | tttgatgttc | actacgaaag | ctcctcaaag | gtcacacaag | 660
| gtttcacatc | atattttcca | cacgttcgat | gagttggagc | ctagtattat | aaaaactttg | 720
| tcattgaggt | ataatcacat | ttacaccatc | ggccactgc | aattacttct | tgatcaaata | 780
| cccgaagaga | aaaagcaaac | tggaattacg | agtctccatg | gctttattgc | agtaaaagaa | 840
| gaaccagagt | gtttccagtg | gcttcagtct | aaagaaccaa | attccgtcgt | ttatgtaaat | 900
| tttgaagta | ctacagtaat | gtcttagaa | gacatgacgg | aatttggttg | gggacttgct | 960
| aatagcaacc | attatttcct | ttggatcatc | cgatcaaact | tggtgatagg | ggaaaatgca | 1020
| gttttgcccc | ctgaacttga | ggaacatata | aagaaaaggg | gctttattgc | tagctggtgc | 1080
| tcacaagaaa | aggtcttgaa | gcaccccttcg | gttggagggt | tcttgactca | ttgtgggtgg | 1140
| ggatcgacca | tcgagagctt | gtctgctggg | gtgccaatga | tatgctgcc | ttattcgtgg | 1200
| gaccagctga | ccaactgtag | gtatatatgc | aaagaatggg | aggttgggct | cgagatggga | 1260
| acgaaagtga | aacgagatga | agtcaaagag | cttgtacaag | agttgatggg | agaaggaggt | 1320
| cacaaaatga | ggaacaaggc | taaagattgg | aaagaaaagg | ctcgcattgg | aaatagctcct | 1380
| aacggttcat | cttcctttgaa | catagacaaa | atggtcaagg | aaatcaccgt | gctagcaaga | 1440
| aactagttac | aaagttgttt | cacattgtgc | tttctattta | agatgtaact | tgttctaat | 1500
| ttaatattgt | ctagatgtat | tgaacctaaa | gtttagttgg | tctcaggaat | tgattttaa | 1560
| tgaaataatg | gtcattaggg | gtgagt | | | | 1586

TABLE 10-continued

Sequences disclosed herein.

SEQ ID NO: 6

```
atggatgcaa tggcaactac tgagaaaaag cctcatgtga tcttcattcc atttcctgca    60
caatctcaca taaaggcaat gctaaagtta gcacaactat tacaccataa gggattacag   120
ataactttcg tgaataccga cttcatccat aatcaatttc tggaatctag tggccctcat   180
tgtttggacg gagccccagg gtttagattc gaaacaattc ctgacggtgt ttcacattcc   240
ccagaggcct ccatcccaat aagagagagt ttactgaggt caatagaaac caactttttg   300
gatcgtttca ttgacttggt cacaaaactt ccagacccac caacttgcat aatctctgat   360
ggctttctgt cagtgtttac tatcgacgct gccaaaaagt tgggtatccc agttatgatg   420
tactggactc ttgctgcatg cggtttcatg ggtttctatc acatccattc tcttatcgaa   480
aagggttttg ctccactgaa agatgcatca tacttaacca acggctacct ggatactgtt   540
attgactggg taccaggtat ggaaggtata agacttaaag attttccttt ggattggtct   600
acagaccttt atgataaagt attgatgttt actacagaag ctccacaaag atctcataag   660
gtttcacatc atatctttca cacctttgat gaattggaac atcaatcat caaaaccttg   720
tctctaagat acaatcatat ctacactatt ggtccattac aattacttct agatcaaatt   780
cctgaagaga aaaagcaaac tggtattaca tccttacacg gctactcttt agtgaaagag   840
gaaccagaat gttttcaatg gctacaaagt aaagagccta attctgtggt ctacgtcaac   900
ttcggaagta acagtcat gtccttgaa gatatgactg aatttggttg gggccttgct   960
aattcaaatc attactttct atggattaac aggtccaatt tggtaatagg ggaaaagcc  1020
gtattacctc cagaattgga ggaacacatc aaaagagag gtttcattgc ttcctggtgt  1080
tctcaggaaa aggtattgaa acatccttct gttggtggtt tccttactca ttgcggttgg  1140
ggctctacaa tcgaatcact aagtgcagga gttccaatga tttgttggcc atattcatgg  1200
gaccaactta caaattgtag gtatatctgt aaagagtggg aagttggatt agaaatggga  1260
acaaaggtta aacgtgatga agtgaaaaga ttggttcagg agttgatggg ggaaggtggc  1320
cacaagatga gaaacaaggc caaagattgg aaggaaaaag ccagaattgc tattgctcct  1380
aacgggtcat cctctctaaa cattgataag atggtcaaag agattacagt cttagccaga  1440
aactaa                                                             1446
```

SEQ ID NO: 7

```
MDAMATTEKK PHVIFIPFPA QSHIKAMLKL AQLLHHKGLQ ITFVNTDFIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                  481
```

SEQ ID NO: 8

```
atggaaaaca agaccgaaac aacagttaga cgtaggcgta gaatcattct gtttccagta    60
ccttttcaag ggcacatcaa tccaatacta caactagcca cgttttgta ctctaaaggt   120
ttttctatta caatctttca caccaatttc aacaaaccaa aaacatccaa ttacccacat   180
ttcacattca gattcatact tgataatgat ccacaagatg aacgtatttc aaacttacct   240
acccacggtc ctttagctgg aatgagaatt ccaatcatca atgaacatgg tgccgatgag   300
cttagaaga aattagagtt acttatgttg catccgaag aggacgagga agtctcttgt   360
ctgattactg acgctctatg gtactttgcc caatctgtgg ctgatagttt gaatttgagg   420
agattggtac taatgacatc cagtctgttt aactttcacg ctcatgttga tttaccacaa   480
tttgacgaat tgggatactt ggaccctgat gacaagacta ggttagagga acaggcctct   540
ggttttccta tgttgaaagt caaagatatc aagtctgcct attctaattg caaatcttg   600
aaagagatct taggaaagat gatcaaacag acaaaggctt catctggagt gatttggaac   660
agtttcaaag agttagaaga gtctgaattg gagactgtaa tcagagaaat tccagcacct   720
tcattcctga taccattacc aaaacatttg actgcttcct cttcctcttt gttggatcat   780
gacagaacag ttttttcaatg gttggaccaa caaccacctca gttctgtttt gtacgtgtca   840
tttggtagta cttctgaagt cgatgaaaag gacttccttg aaatcgcaag aggcttagtc   900
gatagtaagc agtcattcct ttgggtcgtg cgtccaggtt tcgtgaaagg ctcaacatgg   960
gtcgaaccac ttccagatgg ttttctaggc gaaagaggta gaatagtcaa atgggttcct  1020
caacaggaag ttttagctca tggcgctatt ggggcattct ggactcattc cggatggaat  1080
tcaactttag aatcagtatg cgaagggta cctatgatct tttcagattt tggtcttgat  1140
caaccactga acgcaagata catgtctgat gttttgaaag tgggtgtata tctagaaaat  1200
ggctgggaaa ggggtgaaat agctaatgca ataagacgtg ttatggttga tgaagagggg  1260
gagtatatca gacaaaacgc aagagtgctg aagcaaaagg ccgacgtttc tctaatgaag  1320
ggaggctctt catacgaatc cttagaatct cttgtttcct catttcatc actgtaa      1377
```

SEQ ID NO: 9

```
MENKTETTVR RRRIILFPV PFQGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SPLIPLPKHL TASSSSLLDH DRTVPQWLDQ QPPSSVLYVS FGSTSEVDEK DPLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

TABLE 10-continued

Sequences disclosed herein.

SEQ ID NO: 10

```
atggctacat ctgattctat tgttgatgac aggaagcagt tgcatgtggc tactttccct    60
tggcttgctt tcggtcatat actgccttac ctacaactat caaaactgat agctgaaaaa   120
ggacataaag tgtcattcct ttcaacaact agaaacattc aaagattatc ttcccacata   180
tcaccattga ttaacgtcgt tcaattgaca cttccaagag tacaggaatt accagaagat   240
gctgaagcta caacagatgt gcatcctgaa gatatcccct acttgaaaaa ggcatccgat   300
ggattacagc ctgaggtcac tagattcctt gagcaacaca gtccagattg gatcatatac   360
gactacactc actattggtt gccttcaatt gcagcatcac taggcatttc tagggcacat   420
ttcagtgtaa ccacacctg ggccattgct acatgggtc catccgctga tgctatgatt    480
aacggcagtg atggtagaac taccgttgaa gatttgacaa ccccaccaaa gtggttccca   540
tttccaacta aagtctgttg gagaaaacac gacttagcaa gactggttcc atacaaggca   600
ccaggaatct cagacggcta tagaatgggt ttagtcctta aagggtctga ctgcctattg   660
tctaagtgtt accatgagtt tgggacacaa tggctaccac ttttggaaac attacaccaa   720
gttcctgtcg taccagttgg tctattacct ccagaaatcc ctggtgatga gaaggacgag   780
acttgggttt caatcaaaaa gtggttagac gggaagcaaa aaggctcagt ggtatatgtg   840
gcactggggt ccgaagtttt agtatctcaa acagaagttg tggaacttgc cttaggtttg   900
gaactatctg gattgccatt tgtctgggcc tacagaaaac caaaaggccc tgcaaagtcc   960
gattcagttg aattgccaga cggctttgtc gagagaacta agatagagg gttggtatgg  1020
acttcatggg ctccacaatt gagaatcctg agtcacgaat ctgtgtgcgg tttcctaaca  1080
cattgtggtt ctggttctat agttgaagga ctgatgtttg gtcatccact tatcatgttg  1140
ccaatctttg gtgaccagcc tttgaatgca cgtctgttag aagataaaca agttggaatt  1200
gaaatcccac gtaatgagga agatggatgt ttaaccaagg agtctgtggc cagatcatta  1260
cgttccgttg tcgttgaaaa ggaaggcgaa atctacaagg ccaatgcccg tgaactttca  1320
aagatctaca atgacacaaa agtagagaag gaatatgttt ctcaatttgt agattacccta  1380
gagaaaaacg ctagagccgt agctattgat catgaatcct aa                      1422
```

SEQ ID NO: 11

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG LVLKGSDCLL VLKGSDCLL SKCYHEFGTQ WLPLLETLHQ   240
VPVVPVGLLP PEIPGDEKDE TWVSIKKWLD GKQKGSVVYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473
```

SEQ ID NO: 12

```
atggctactt ctgattccat cgttgacgat agaaagcaat tgcatgttgc tactttttcca    60
tggttggctt tcggtcatat tttgccatac ttgcaattgt ccaagttgat tgctgaaaag   120
ggtcacaagg tttttcattct tgtctaccac agaaacatcc aaagattgtc ctctcatatc   180
tcccattga tcaacgttgt tcaattgact ttgccaagag tccaagaatt gccagaagat   240
gctgaagcta ctactgatgt tcatccagaa gatatccctt acttgaaaaa ggcttccgat   300
ggtttacaac cagaagttac tagattcttg aacaacatt ccccagattg gatcatctac   360
gattatactc attactggtt gccatccatt gctgcttcat gggtatttc tagagcccat   420
ttctctgtta ctactccatg ggctattgct tatatgggtc catctgctga tgctatgatt   480
aacggttctg atggtagaac taccgttgaa gatttgacta ctccaccaaa gtggttttca   540
tttccaacaa aagtctgttg gagaaaacac gatttggcta gattggttcc atacaaagct   600
ccaggtattt ctgatggtta cagaatgggt atggttttga aaggttccga ttgcttgttg   660
tctaagtgct atcatgaatt cggtactcaa tggttgcctt tgttggaaac attgcatcaa   720
gttccagttg ttccagtagg tttgttgcca ccagaaattc caggtgacga aaaagacgaa   780
acttgggttt ccatcaaaaa gtggttggat ggtaagcaaa agggttctgt tgtttatgtt   840
gctttggggt ccgaagtttt ggtttctcaa accgaagttg ttgaattggc tttgggtttg   900
gaattgtctg gtttgccatt tgtttgggct tacagaaaac ctaaaggtcc agctaagtct   960
gattctgttg aattgccaga tggtttcgtt gaaagaacta gaagataggg tttggtttgg  1020
acttcttggg ctccacaatt gagaatttttg tctcatgaat ccgtctgtgg tttcttgact  1080
cattgtggtt ctggttctat cgttgaaggt ttgatgtttg gtcacccatt gattatgttg  1140
ccaatctttg gtgaccaacc attgaacgct agattattga agataagca agtcggtatc  1200
gaaatcccaa gaaatgaaga agatggttgc ttgaccaaag aatctgttgc tagatctttg  1260
agatccgttg tcgttgaaaa agaaggtgaa atctacaagg ctaacgctag agaattgtcc  1320
aagatctaca acgataccaa ggtcgaaaaa gaatacgttt cccaattcgt tgactacttg  1380
gaaaagaatg ctagagctgt tgccattgat catgaatctt ga                      1422
```

SEQ ID NO: 13

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG MVLKGSDCLL SKCYHEFGTQ WLPLLETLHQ   240
VPVVPVGLLP PEIPGDEKDE TWVSIKKWLD GKQKGSVVYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473
```

TABLE 10-continued

Sequences disclosed herein.

SEQ ID NO: 14

```
atggactccg gctactcctc ctcctacgcc gccgccgccg ggatgcacgt cgtgatctgc    60
ccgtggctcg ccttcggcca cctgctcccg tgcctcgacc tcgcccagcg cctcgcgtcg   120
cggggccacc gcgtgtcgtt cgtctccacg ccgcggaaca tatcccgcct cccgccggtg   180
cgccccgcgc tcgcgccgct cgtcgccttc gtggcgctgc cgctcccgcg cgtcgagggg   240
ctccccgacg gcgcccagtc caccaacgac gtcccccacg acaggccgga catggtcgag   300
ctccaccgga gggccttcga cgggctcgcc gcgcccttct cggagttctt gggcaccgcg   360
tgcgccgact gggtcatcgt cgacgtcttc caccactggg ccgcagccgc cgctctcgag   420
cacaaggtgc catgtgcaat gatgttgttg ggctctgcac atatgatcgc ttccatagca   480
gacagacgac tcgagcgcgc ggagacagag tcgcctgccg gctgccggga ggacgccca   540
gcggcggcgc caacgttcga ggtggcgagg atgaagttga tacgaaccaa aggctcatcg   600
ggaatgtccc tcgccgagcg cttctccttg acgctctcga ggagcagcct cgtcgtcggg   660
cggagctgcg tggagttcga gccggagacc gtcccgctcc tgtcgacgct ccgcggtaag   720
cctattacct tccttggcct tatgccgccg ttgcatgaag gccgccgcga ggacggcgag   780
gatgccaccg tccgctggct cgacgcgcag ccggccaagt ccgtcgtgta cgtcgcgcta   840
ggcagcgagg tgccactggg agtggagaag gtccacgagc tcgcgctcgg gctggagctc   900
gccgggacgc gcttcctctg ggctcttagg aagcccactg gcgtctccga cgccgacctc   960
ctccccgccg gcttcgagga gcgcacgcgc ggccgcgtcg tcgtggcgac gagatgggtt  1020
cctcagatga gcatactggc gcacgccgcc gtgggcgcgt tcctgaccca ctgcggctgg  1080
aactcgacca tcgaggggct catgttcggc cacccgctta tcatgctgcc gatcttcggc  1140
gaccaggggac cgaacgcgcg gctaatcgag gcgaagaacg ccggattgca ggtggcaaga  1200
aacgacggcg atggatcgtt cgaccgagaa ggcgtcgcgg cggcgattcg tgcagtcgcg  1260
gtggaggaag aaagcagcaa agtgtttcaa gccaaagcca agaagctgca ggagatcgtc  1320
gcggacatgg cctgccatga gaggtacatc gacggattca ttcagcaatt gagatcttac  1380
aaggattga                                                          1389
```

SEQ ID NO: 15

```
atggatagtg gctactcctc atcttatgct gctgccgctg gtatgcacgt tgtgatctgc    60
ccttggttgg cctttggtca cctgttacca tgtctggatt tagcccaaag actggcctca   120
agaggccata gagtatcatt tgtgtctact cctagaaata tctctcgttt accaccagtc   180
agacctgctc tagctcctct agttgcattc gttgctcttc cacttccaag agtagaagga   240
ttgccagacg gcgctgaatc tactaatgac gtaccacatg atagacctga catggtcgaa   300
ttgcatagaa gagcctttga tggattggca gctccatttt ctgagttcct gggcacagca   360
tgtgcagact gggttatagt cgatgtattt catcactggg ctgctgcagc cgcattggaa   420
cataaggtgc cttgtgctat gatgttgtta gggtcagcac acatgatcgc atccatagct   480
gatagaagat tggaaagagc tgaaacagaa tccccagccg cagcaggaca aggtaggcca   540
gctgccgccc aacctttga agtggctaga atgaaattga ttcgtactaa aggtagttca   600
gggatgagtc ttgctgaaag gttttctctg acattatcta gatcatcatt agttgtaggt   660
agatcctgcg tcgagttcga acctgaaaca gtacctttac tatctacttt gagaggcaaa   720
cctattactt tccttggtct aatgcctcca ttacatgaag gaaggagaga agatggtgaa   780
gatgctactg ttaggtggtt agatgcccaa cctgctaagt ctgttgttta cgttgcattg   840
ggttctgagg taccactagg ggtggaaaag gtgcatgaat tgcattagg acttgagctg   900
gccggaacaa gattccttg gcttgaga aaaccaaccg gtgtttctga cgccgacttg   960
ctaccagctg ggttcgaaga gagaacaaga ggccgtggtg tcgttgctac tagatgggtc  1020
ccacaaatga gtattctagc tcatgcagct gtaggggcct ttctaaccca ttgcggttgg  1080
aactcaacaa tagaaggact gatgtttggt catccactta ttatgttacc aatctttggc  1140
gatcaggggac ctaacgcaag attgattgag gcaaagaacg caggtctgca ggttgcacgt  1200
aatgatggtg atggttcctt tgatagaaa ggcgttgcag ctgccatcag agcagtcgcc  1260
gttgaggaag agtcatctaa agttttccaa gctaaggcca aaaaattaca agagattgtg  1320
gctgacatgg cttgtcacga aagatacatc gatggtttca tccaacaatt gagaagttat  1380
aaaagactaa                                                         1389
```

SEQ ID NO: 16

```
MDSGYSSSYA AAAGMHVVIC PWLAFGHLLP CLDLAQRLAS RGHRVSFVST PRNISRLPPV    60
RPALAPLVAF VALPLPRVEG LPDGAESTND VPHDRPDMVE LHRRAFDGLA APFSEFLGTA   120
CADWVIVDVF HHWAAAAALE HKVPCAMMLL GSAHMIASIA DRRLERAETE SPAAAGQGRP   180
AAAPTFEVAR MKLIRTKGSS GMSLAERFSL TLSRSSLVVG RSCVEFEPET VPLLSTLRGK   240
PITFLGLMPP LHEGRREDGE DATVRWLDAQ PAKSVVYVAL GSEVPLGVEK VHELALGLEL   300
AGTRFLWALR KPTGVSDADL LPAGFEERTR GRGVVATRWV PQMSILAHAA VGAFLTHCGW   360
NSTIEGLMFG HPLIMLPIFG DQGPNARLIE AKNAGLQVAR NDGDGSFDRE GVAAAIRAVA   420
VEEESSKVFQ AKAKKLQEIV ADMACHERYI DGFIQQLRSY KD                      462
```

SEQ ID NO: 17

```
MDSGYSSSYA AAAGMHVVIC PWLAFGHLLP CLDLAQRLAS RGHRVSFVST PRNISRLPPV    60
RPALAPLVAF VALPLPRVEG LPDGAESTND VPHDRPDMVE LHRRAFDGLA APFSEFLGTA   120
CADWVIVDVF HHWAAAAALE HKVPCAMMLL GSAHMIASIA DRRLERAETE SPAAAGQGRP   180
AAAPTFEVAR MKLIRTKGSS GMSLAERFSL TLSRSSLVVG RSCVEFEPET VPLLSTLRGK   240
PITFLGLLPP EIPGDEKDET WVSIKKWLDG KQKGSVYVA LGSEALVSQT EVVELALGLE   300
LSGLPFVWAY RKPKGPAKSD SVELPDGFVE RTRDRGLVWT SWAPQLRILS HESVCGFLTH   360
CGSGSIVEGL MFGHPLIMLP IFGDQPLNAR LLEDKQVGIE IARNDGDGSF DREGVAAAIR   420
AVAVEEESSK VFQAKAKKLQ EIVADMACHE RYIDGFIQQL RSYKD                   465
```

TABLE 10-continued

Sequences disclosed herein.

SEQ ID NO: 18

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG MVLKGSDCLL SKCYHEFGTQ WLPLLETLHQ   240
VPVVPVGLMP PLHEGRREDG EDATVRWLDA QPAKSVVYVA LGSEVPLGVE KVHELALGLE   300
LAGTRFLWAL RKPTGVSDAD LLPAGFEERT RGRGVVATRW VPQMSILAHA AVGAFLTHCG   360
WNSTIEGLMF GHPLIMLPIF GDQGPNARLI EAKNAGLQVP RNEEDGCLTK ESVARSLRSV   420
VVEKEGEIYK ANARELSKIY NDTKVEKEYV SQFVDYLEKN ARAVAIDHES             470
```

SEQ ID NO: 19

```
atggctttgg taaacccaac cgctctttc tatggtacct ctatcagaac aagacctaca    60
aacttactaa atccaactca aaagctaaga ccagtttcat catcttcctt accttcttc   120
tcatcagtta gtgcgattct tactgaaaaa catcaatcta atccttctga gaacaacaat   180
ttgcaaactc atctagaaac tcctttcaac tttgatagtt atatgttgga aaaagtcaac   240
atggttaacg aggcgcttga tgcatctgtc ccactaaaag acccaatcaa aatccatgaa   300
tccatgagat actcttattt ggcaggcggt aagagaatca gaccaatgat gtgtattgca   360
gcctgcgaaa tagtcggagg taatatcctt aacgccatgc cagccgcatg tgccgtggaa   420
atgattcata ctatgtcttt ggtgcatgac gatcttccat gtatggataa tgatgacttc   480
agaagaggta aacctatttc acacaaggtc tacggggagg aaatggcagt attgaccggc   540
gatgctttac taagtttatc tttcgaacat atagctactg ctacaaaggg tgtatcaaag   600
gatagaatcg tcagagctat aggggagttg gcccgttcag ttggctccga aggtttagtg   660
gctggacaag ttgtagatat cttgtcagag ggtgctgatg ttggattaga tcacctagaa   720
tacattcaca tccacaaaac agcaatgttg cttgagtcct cagtagttat tggcgctatc   780
atgggaggag gatctgatca gcagatcgaa aagttgagaa aattcgctag atctattggt   840
ctactattcc aagttgtgga tgacttttga gatgttacaa aatctaccga agagttgggg   900
aaaacagctg gtaaggattt gttgacagat aagacaactt acccaaagtt gttaggtata   960
gaaaagtcca gagaatttgc cgaaaaactt aacaaggaag cacaagagca attaagtggc  1020
tttgatagac gtaaggcagc tcctttgatc gcgttagcca actacaatgc gtaccgtcaa  1080
aattga                                                            1086
```

SEQ ID NO: 20

```
MALVNPTALF YGTSIRTRPT NLLNPTQKLR PVSSSSLPSF SSVSAILTEK HQSNPSENNN    60
LQTHLETPFN FDSYMLEKVN MVNEALDASV PLKDPIKIHE SMRYSLLAGG KRIRPMMCIA   120
ACEIVGGNIL NAMPAACAVE MIHTMSLVHD DLPCMDNDDF RRGKPISHKV YGEEMAVLTG   180
DALLSLSFEH IATATKGVSK DRIVRAIGEL ARSVGSEGLV AGQVVDILSE GADVGLDHLE   240
YIHIHKTAML LESSVVIGAI MGGGSDQQIE KLRKFARSIG LLFQVVDDIL DVTKSTEELG   300
KTAGKDLLTD KTTYPKLLGI EKSREFAEKL NKEAQEQLSG FDRRKAAPLI ALANYNAYRQ   360
N                                                                 361
```

SEQ ID NO: 21

```
atggctgagc aacaaatatc taacttgctg tctatgtttg atgcttcaca tgctagtcag    60
aaattagaaa ttactgtcca aatgatggac ataccatt acagaaaac gcctccagat     120
tcctcatctt ctgaaggcgg ttcattgtct agatacgacg agagaagagt ctcttttgcct  180
ctcagtcata atgctgcctc tccagatatt gtatcacaac tatgtttttc cactgcaatg   240
tcttcagagt tgaatcacag atggaaatct caaagattaa aggtggccga ttctccttac   300
aactatatcc taacattacc atcaaaagga attagaggtg cctttatcga ttccctgaac   360
gtatggttgg aggttccaga ggatgaaaca tcagtcatca aggaagttat tggtatgctc   420
cacaactctt cattaatcat tgatgacttc caagataatt ctccacttag aagaggaaag   480
ccatctaccc atacagtctt cggccctgcc caggctatca atactgctac ttacgttata   540
gttaaagcaa tcgaaaagat acaagacata gtgggacacg atgcattggc agatgttacg   600
ggtactatta caactatttt ccaaggtcag gccatggact gtggtggac agcaaatgca   660
atcgttccat caatacagga atacttactt atggtaaaca ataaaaccgg tgctctcttt   720
agactgagtt tggagttgtt agctctgaat tccgaagcca gtatttctga ctctgcttta   780
gaaagtttat ctagtgctgt ttccttgcta ggtcaatact tccaaatcag agacgactat   840
atgaacttga tcgataacaa gtatacagat cagaaaggct ctgcgaaga tcttgatgaa   900
ggcaagtact cactaacact tattcatgcc ctccaaactg attcatccga tctactgacc   960
aacatccttt caatgagaag agtgcaagga agttaacg cacaaaagag atgttggttc  1020
tggaaatga                                                         1029
```

SEQ ID NO: 22

```
MAEQQISNLL SMFDASHASQ KLEITVQMMD TYHYRETPPD SSSSEGGSLS RYDERRVSLP    60
LSHNAASPDI VSQLCFSTAM SSELNHRWKS QRLKVADSPY NYILTLPSKG IRGAFIDSLN   120
VWLEVPEDET SVIKEVIGML HNSSLIIDDF QDNSPLRRGK PSTHTVFGPA QAINTATYVI   180
VKAIEKIQDI VGHDALADVT GTITTIFQGG AMDLWWTANA IVPSIQEYLL MVNDKTGALF   240
RLSLELLALN SEASISDSAL ESLSSAVSLL GQYFQIRDDY MNLIDNKYTD QKGFCEDLDE   300
GKYSLTLIHA LQTDSSDLLT NILSMRRVQG KLTAQKRCWF WK                     342
```

SEQ ID NO: 23

```
atggaaaaga ctaaggagaa agcagaacgt atcttgctgg agccatacag atacttatta    60
caactaccag gaaagcaagt ccgttctaaa ctatcacaag cgttcaatca ctggttaaaa   120
gttcctgaag ataagttaca aatcattatt gaagtcacag aaatgctaca caatgcttct   180
```

TABLE 10-continued

Sequences disclosed herein.

```
ttactgatcg atgatataga ggattcttcc aaactgagaa gaggttttcc tgtcgctcat    240
tccatatacg gggtaccaag tgtaatcaac tcagctaatt acgtctactt cttgggattg    300
gaaaaagtat tgacattaga tcatccagac gctgtaaagc tattcaccag acaacttctt    360
gaattgcatc aaggtcaagg tttggatatc tattggagag acacttatac ttgcccaaca    420
gaagaggagt acaaagcaat ggttctacaa aagactggcg gtttgttcgg acttgccgtt    480
ggtctgatgc aacttttctc tgattacaag gaggacttaa agcctctgtt ggataccttg    540
ggcttgtttt tccagattag agatgactac gctaacttac attcaaagga atattcagaa    600
aacaaatcat tctgtgaaga tttgactgaa gggaagttta gttttccaac aatccacgcc    660
atttggtcaa gaccagaatc tactcaagtg caaaacattc tgcgtcagag aacagagaat    720
attgacatca aaaagtattg tgttcagtac ttggaagatg ttggttcttt tgcttacaca    780
agacatacac ttagagaatt agaggcaaaa gcatacaagc aaatagaagc ctgtggaggc    840
aatccttctc tagtggcatt ggttaaacat ttgtccaaaa tgttcaccga ggaaaacaag    900
taa                                                                  903
```

SEQ ID NO: 24

```
MEKTKEKAER ILLEPYRYLL QLPGKQVRSK LSQAFNHWLK VPEDKLQIII EVTEMLHNAS     60
LLIDDIEDSS KLRRGFPVAH SIYGVPSVIN SANYVYFLGL EKVLTLDHPD AVKLFTRQLL    120
ELHQGQGLDI YWRDTYTCPT EEEYKAMVLQ KTGGLFGLAV GLMQLFSDYK EDLKPLLDTL    180
GLFFQIRDDY ANLHSKEYSE NKSFCEDLTE GKFSFPTIHA IWSRPESTQV QNILRQRTEN    240
IDIKKYCVQY LEDVGSFAYT RHTLRELEAK AYKQIEACGG NPSLVALVKH LSKMFTEENK    300
```

SEQ ID NO: 25

```
atggcaagat tctattttct taacgcacta ttgatggtta tctcattaca atcaactaca     60
gccttcactc cagctaaact tgcttatcca acaacaacaa cagctctaaa tgtcgcctcc    120
gccgaaactt ctttcagtct agatgaatac ttggcctcta agataggacc tatagagtct    180
gccttggaag catcagtcaa atccagaatt ccacagaccg ataagatctg cgaatctatg    240
gcctactctt tgatggcagg aggcaagaga attagaccag tgttgtgtat cgctgcatgt    300
gagatgttcg gtggatccca agatgtcgct atgcctactg ctgtggcatt agaaatgata    360
cacacaatgt ctttgattca tgatgatttg ccatccatgg ataacgatga cttgagaaga    420
ggtaaaccaa caaaccatgt cgtttttcggc gaagtgtgag ctattcttgc aggtgactct    480
ttattgtcaa cttccttcga gcacgtcgct agagaaacaa aaggagtgtc agcagaaaag    540
atcgtggatg ttatcgctag attaggcaaa tctgttggtg ccgagggcct tgctggcggt    600
caagttatgg acttagaatg tgaagctaaa ccaggtacca cattgacga cttgaaatgg    660
attcatatcc ataaaaccgc tacattgtta caagttgctc tagcttctgg tgcagttcta    720
ggtggtgcaa ctcctgaaga ggttgctgca tgcgagttgt ttgctatgaa tataggtctt    780
gccttttcaag ttgccgacga tatccttgat gtaaccgctt catcagaaga tttgggtaaa    840
actgcaggca aagatgaagc tactgataag acaacttacc caaagttatt aggattagaa    900
gagagtaagg catacgcaag acaactaatc gatgaagcca aggaaagttt ggctcctttt    960
gggatagag ctgccccttt attggccatt gcagatttca ttattgatag aaagaattga   1020
```

SEQ ID NO: 26

```
MARFYFLNAL LMVISLQSTT AFTPAKLAYP TTTTALNVAS AETSFSLDEY LASKIGPIES     60
ALEASVKSRI PQTDKICESM AYSLMAGGKR IRPVLCIAAC EMFGGSQDVA MPTAVALEMI    120
HTMSLIHDDL PSMDNDDLRR GKPTNHVVFG EDVAILAGDS LLSTSFEHVA RETKGVSAEK    180
IVDVIARLGK SVGAEGLAGG QVMDLECEAK PGTTLDDLKW IHIHKTATLL QVAVASGAVL    240
GGATPEEVAA CELFAMNIGL AFQVADDILD VTASSEDLGK TAGKDEATDK TTYPKLLGLE    300
ESKAYARQLI DEAKESLAPF GDRAAPLLAI ADFIIDRKN                           339
```

SEQ ID NO: 27

```
atgcacttag caccacgtag agtccctaga ggtagaagat caccacctga cagagttcct     60
gaaagacaag gtgccttggg tagaagacgt ggagctggct ctactggctg tgcccgtgct    120
gctgctggtg ttcaccgtag aagaggagga ggcgaggctg atccatcagc tgctgtgcat    180
agaggctggc aagccggtgg tggcaccggt ttgcctgata ggtggtgtc taccgcagcc    240
gccttagaaa tgtttcatgc ttttgcttta atccatgatg atatcatgga tgatagtgca    300
actagaaagg gctccccaac tgttcacaga gccctagctg atcgtttagg cgctgctctg    360
gacccagatc aggccggtca actaggagtt tctactgcta tcttggttgg agatctggct    420
ttgacatggt ccgatgaatt gttatacgct ccattgactc cacatagact ggcagcagta    480
ctaccattgg taacagctat gagagctgaa accgttcatg gccaatatct tgatataact    540
agtgctagaa gacctgggac cgatacttct cttgcattga aatagccag atataagaca    600
gcagcttaca caatggaacg tccactgcac attggtcagc cctgcctggg ggcaagacca    660
gaactattag cagggctttc agcatacgcc ttgccagctg gagaagcctt ccaattggca    720
gatgacctgc taggcgtctt cggtgatcca agacgtacag ggaaacctga cctagatgat    780
cttagaggtg gaaagcatac tgtcttagtc gccttggcaa gagaacatgc cactccagaa    840
cagagacaca cattggatac attattggga acaccaggtc ttgatagaca aggcgcttca    900
agactaagat gcgtattggt agcaactggt gcaagagccg aagccgaaag acttattaca    960
gagagaagag atcaagcatt aactgcattg aacgcattaa cactgccacc tcctttagct   1020
gaggcattag caagattgac attagggtct acagctcatc ctgcctaa                1068
```

SEQ ID NO: 28

```
MHLAPRRVPR GRRSPPDRVP ERQGALGRRR GAGSTGCARA AAGVHRRRGG GEADPSAAVH     60
RGWQAGGGTG LPDEVVSTAA ALEMFHAFAL IHDDIMDDSA TRRGSPTVHR ALADRLGAAL    120
DPDQAGQLGV STAILVGDLA LTWSDELLYA PLTPHRLAAV LPLVTAMRAE TVHGQYLDIT    180
SARRPGTDTS LALRIARYKT AAYTMERPLH IGAALAGARP ELLAGLSAYA LPAGEAFQLA    240
```

TABLE 10-continued

Sequences disclosed herein.

```
DDLLGVFGDP RRTGKPDLDD LRGGKHTVLV ALAREHATPE QRHTLDTLLG TPGLDRQGAS    300
RLRCVLVATG ARAEAERLIT ERRDQALTAL NALTLPPPLA EALARLTLGS TAHPA         355
```

SEQ ID NO: 29

```
atgtcatatt tcgataacta cttcaatgag atagttaatt ccgtgaacga catcattaag    60
tcttacatct ctggcgacgt accaaaacta tacgaagcct cctaccattt gtttacatca   120
ggaggaaaga gactaagacc attgatcctt acaatttctt ctgatctttt cggtggacag   180
agagaaagag catactatgc tggcgcagca atcgaagttt tgcacacatt cactttggtt   240
cacgatgata tcatggatca agataacatt cgtagaggtc ttcctactgt acatgtcaag   300
tatggcctac cttttggccat tttagctggt gacttattgc atgcaaaagc ctttcaattg   360
ttgactcagg cattgagagg tctaccatct gaaactatca tcaaggcgtt tgatatcttt   420
acaagatcta tcattatcat atcagaaggt caagctgtcg atatgaatt cgaagataga    480
attgatatca aggaacaaga gtatttggat atgatatctc gtaaaccgc tgccttattc    540
tcagcttctt cttccattgg ggcgttgata gctggagcta atgataacga tgtgagatta    600
atgtccgatt tcggtacaaa tcttgggatc gcatttcaaa ttgtagatga tatacttggt    660
ttaacagctg atgaaaaaga gctaggaaaa cctgttttca gtgatatcag agaaggtaaa    720
aagaccatat tagtcattaa gactttagaa ttgtgtaagg aagacgagaa aaagattgtg    780
ttaaaagcgc taggcaacaa gtcagcatca aaggaagagt tgatgagttc tgctgacata    840
atcaaaaagt actcattgga ttacgcctac aacttagctg agaaatacta caaaaacgcc    900
atcgattctc taaatcaagt ttcaagtaaa agtgatattc cagggaaggc attgaaatat    960
cttgctgaat tcaccatcag aagacgtaag taa                                993
```

SEQ ID NO: 30

```
MSYFDNYFNE IVNSVNDIIK SYISGDVPKL YEASYHLFTS GGKRLRPLIL TISSDLFGGQ     60
RERAYYAGAA IEVLHTFTLV HDDIMDQDNI RRGLPTVHVK YGLPLAILAG DLLHAKAFQL    120
LTQALRGLPS ETIIKAFDIF TRSIIIISEG QAVDMEFEDR IDIKEQEYLD MISRKTAALF    180
SASSSIGALI AGANDNDVRL MSDFGTNLGI AFQIVDDILG LTADEKELGK PVFSDIREGK    240
KTILVIKTLE LCKEDEKKIV LKALGNKSAS KEELMSSADI IKKYSLDYAY NLAEKYYKNA    300
IDSLNQVSSK SDIPGKALKY LAEFTIRRRK                                    330
```

SEQ ID NO: 31

```
atggtcgcac aaactttcaa cctggatacc tacttatccc aaagacaaca acaagttgaa    60
gaggccctaa gtgctgctct tgtgccagct tatcctgaga gaatatacga agctatgaa   120
tactccctcc tggcaggtgg caaaagatta agacctatct tatgtttagc tgcttgcgaa    180
ttggcaggtg gttctgttga acaagccatg ccaactgcgt gtgcacttga aatgatccat    240
acaatgtcac taattcatga tgacctgcca gccatggata cgatgatttt cagaagagga    300
aagccaacta atcacaaggt gttcggggaa gatatagcca tcttagcgaag tgatgcgctt    360
ttagcttacg cttttgaaca tattgcttct caaacaagag gagtaccacc tcaattggtg    420
ctacaagtta ttgctagaat cggacacgcc gttgctgcaa caggcctcgt tggaggccaa    480
gtcgtagacc ttgaatctga aggtaaagct atttccttag aaacattgga gtatattcac    540
tcacataaga ctggagcctt gctggaagca tcagttgtct caggcggtat tctcgcaggg    600
gcagatgaag agcttttggc cagattgtct cattacgcta gagatatagg cttggctttt    660
caaatcgtcg atgatatcct ggatgttact gctacatctg aacagttggg gaaaaccgct    720
ggtaaagacc aggcagccgc aaaggcaact tatccaagtc tattgggttt agaagcctct    780
agacagaaag cggaagagtt gattcaatct gctaaggaag cctaagacc ttacggttca    840
caagcagagc cactcctagc gctggcagac ttcatcacac gtcgtcagca ttaa          894
```

SEQ ID NO: 32

```
MVAQTFNLDT YLSQRQQVE EALSAALVPA YPERIYEAMR YSLLAGGKRL RPILCLAACE      60
LAGGSVEQAM PTACALEMIH TMSLIHDDLP AMDNDDFRRG KPTNHKVFGE DIAILAGDAL    120
LAYAFEHIAS QTRGVPPQLV LQVIARIGHA VAATGLVGGQ VVDLESEGKA ISLETLEYIH    180
SHKTGALLEA SVVSGGILAG ADEELLARLS HYARDIGLAF QIVDDILDVT ATSEQLGKTA    240
GKDQAAAKAT YPSLLGLEAS RQKAEELIQS AKEALRPYGS QAEPLLALAD FITRRQH       297
```

SEQ ID NO: 33

```
atgaaaccg gtttatctc accagcaaca gtatttcatc acagaatctc accagcgacc      60
actttcagac atcacttatc acctgctact acaaactcta caggcattgt cgccttaaga   120
gacatcaact tcagatgtaa agcagtttct aaagagtact ctgatctgtt gcagaaagat   180
gaggcttctt tcacaaaatg ggacgatgac aaggtgaaag atcatcttga taccaacaaa   240
aacttatacc caaatgatga gattaaggaa tttgttgaat cagtaaaagc tatgttcggt   300
agtatgaatg acggggagat aaacgtctct gcatacgata ctgcatgggt tgctttggtt   360
caagatgtcg atggatcagg tagtcctcag ttcccttctt ctttagaatg gattgccaac   420
aatcaattgt cagatggatc atgggagat catttgctgt ctctcagctca cgatagaatc   480
atcaacacat tagcatgcgt tattcacttt acaagttgga atgttcatcc ttctaagtgt   540
gaaaaaggtt tgaattttct gagagaaaac atttgcaat tagaagatga aaacgcagaa   600
catatgccaa ttggttttga gtaacattcc ccatcactaa ttgatatcgc gaaaagttg   660
aacattgaag tacctgagga tactccagca cttaaagaga tctacgcacg tagagatatc   720
aagttcacta agatcccaat ggaagttctt cacaaggtac ctactactta gttacatcta   780
ttggaaggaa tgcctgattt ggagtgggaa aaactgttaa agctacaatg taaagatggt   840
agtttcttgt ttttccccatc tagtaccgca ttcgccctaa tgcaaacaaa agatgagaaa   900
tgcttacagt atctaacaaa tatcgtcact aagttcaacg gtggcgtgcc taatgtgtac   960
ccagtcgatt tgtttgaaca tatttgggtt gttgatagac tgcagagatt ggggattgcc   1020
agatacttca aatcagagat aaaagattgt gtagagtata tcaataagta ctggaccaaa   1080
```

TABLE 10-continued

Sequences disclosed herein.

```
aatggaattt gttgggctag aaatactcac gttcaagata tcgatgatac agccatggga    1140
ttcagagtgt tgagagcgca cggttatgac gtcactccag atgttttag acaatttgaa    1200
aaagatggta aattcgtttg cttttgcaggg caatcaacac aagccgtgac aggaatgttt    1260
aacgtttaca gagcctctca aatgttgttc caggggaga gaattttgga agatgccaaa    1320
aagttctctt acaattactt aaaggaaaag caaagtacca acgaattgct ggataaatgg    1380
ataatcgcta aagatctacc tggtgaagtt ggttatgctc tggatatccc atggtatgct    1440
tccttaccaa gattggaaac tcgttattac cttgaacaat acggcggtga agatgatgtc    1500
tggataggca agacattata cagaatgggt tacgtgtcca ataacacata tctagaaatg    1560
gcaaagctgg attacaataa ctatgttgca gtccttcaat tagaatggta cacaatacaa    1620
caatggtacg tcgatattgg tatagagaag ttcgaatctg acaacatcaa gtcagtcctg    1680
```

SEQ ID NO: 34

```
MKTGFISPAT VFHHRISPAT TFRHHLSPAT TNSTGIVALR DINFRCKAVS KEYSDLLQKD     60
EASFTKWDDD KVKDHLDTNK NLYPNDEIKE FVESVKAMFG SMNDGEINVS AYDTAWVALV    120
QDVDGSGSPQ FPSSLEWIAN NQLSDGSWGD HLLFSAHDRI INTLACVIAL TSWNVHPSKC    180
EKGLNFLREN ICKLEDENAE HMPIGFEVTF PSLIDIAKKL NIEVPEDTPA LKEIYARRDI    240
KLTKIPMEVL HKVPTTLLHS LEGMPDLEWE KLLKLQCKDG SFLFSPSSTA FALMQTKDEK    300
CLQYLTNIVT KFNGGVPNVY PVDLFEHIWV VDRLQRLGIA RYFKSEIKDC VEYINKYWTK    360
NGICWARNTH VQDIDDTAMG FRVLRAHGYD VTPDVFRQFE KDGKFVCFAG QSTQAVTGMF    420
NVYRASQMLF PGERILEDAK KFSYNYLKEK QSTNELLDKW IIAKDLPGEV GYALDIPWYA    480
SLPRLETRYY LEQYGGEDDV WIGKTLYRMG YVSNNTYLEM AKLDYNNYVA VLQLEWYTIQ    540
QWYVDIGIEK FESDNIKSVL VSYYLAAASI FEPERSKERI AWAKTTILVD KITSIFDSSQ    600
SSKEDITAFI DKFRNKSSSK KHSINGEPWH EVMVALKKTL HGFALDALMT HSQDIHPQLH    660
QAWEMWLTKL QDGVDVTAEL MVQMINMTAG RWVSKELLTH PQYQRLSTVT NSVCHDITKL    720
HNFKENSTTV DSKVQELVQL VFSDTPDDLD QDMKQTFLTV MKTFYYKAWC DPNTINDHIS    780
KVFEIVI                                                              787
```

SEQ ID NO: 35

```
atgcctgatg cacacgatgc tccacctcca caaataagac agagaacact agtagatgag     60
gctacccaac tgctaactga gtccgcagaa gatgcatggg gtgaagtcag tgtgtcagaa    120
tacgaaacag caaggctagt tgcccatgct acatggttag gtggacacgc cacaagagtg    180
gccttccttc tggagagaca acacgaagac gggtcatggg gtccaccagg tggatatagg    240
ttagtcccta cattatctgc tgttcacgca ttattgacat gtcttgcctc tcctgctcag    300
gatcatgccg ttccacatga tagactttta agagctgttg acgcaggctt gactgcccttg    360
agaagattgg ggacatctga ctcccccacct gatactatag cagttgagct ggttatccca    420
tctttgctag agggcattca acacttactg gaccctgctc atcctcatag tagaccagcc    480
ttctctcaac atagaggctc tcttgtttgt cctggtggac tagatgggag aactctagga    540
gctttggaga cacacgccgc agcaggtaca ccagtacgag gaaaagtctg gcacgcttcc    600
gagactttgg gcttgagtac cgaagctgct tctcacttgc aaccagccca aggtataatc    660
ggtggctctg ctgctgccac agcaacatgg ctaaccaggg ttgccaccatc tcaacagtca    720
gattctgcca gaagatacct tgaggaatta caacacagat actctggccc agttccttcc    780
attaccccta tcacatactt cgaaagagca tggttattga acaattttgc agcagccgtt    840
gttccttgtg aggctccagc tgctttgttg gattccttag aagcagcact tacaccacaa    900
ggtgctcctg ctggagcagg attgcctcca gatgctgatg atacagccgc tgtgttgctt    960
gcattggcaa cacatgggag aggtagaaga ccagaagtac tgatggatta caggactgac   1020
gggtatttcc aatgctttat tgggaaaggg actccatcaa cgctcacgta                1080
ttggaaacat tagggcatca tgtggcccaa catccacaag atagagccag atacggatca    1140
gccatggata ccgcatcagc ttggctgctg gcagctcaaa agcaagatgg ctcttggtta    1200
gataaatggc atgcctcacc atactacgct actgtttgtt gcacacaagc cctagccgct    1260
catgcaagtc ctgcaactgc accagctaga cagagagctg tcagatgggt tttagccaca    1320
caaagatccg atggcggttg gggtctatgg cattcaactg ttgaagagac tgcttatgcc    1380
ttacagatct ggccccacc ttctggtggt ggcaatatcc cagtccaaca agcacttact    1440
agaggcagag caagattgtg tggagccttg ccactgactc ctttatggca tgataaggat    1500
ttgtatactc cagtaagagt agtcagagct gccagagctg ctgctctgta cactaccaga    1560
gatctattgt taccaccatt gtaa                                           1584
```

SEQ ID NO: 36

```
MPDAHDAPPP QIRQRTLVDE ATQLLTESAE DAWGEVSVSE YETARLVAHA TWLGGHATRV     60
AFLLERQHED GSWGPPGGYR LVPTLSAVHA LLTCLASPAQ DHGVPHDRLL RAVDAGLTAL    120
RRLGTSDSPP DTIAVELVIP SLLEGIQHLL DPAHPHSRPA FSQHRGSLVC PGGLDGRTLG    180
ALRSHAAAGT PVPGKVWHAS ETLGLSTEAA SHLQPAQGII GGSAAATATW LTRVAPSQQS    240
DSARRYLEEL QHRYSGPVPS ITPITYFERA WLLNNFAAAG VPCEAPAALL DSLEAALTPQ    300
GAPAGAGLPP DADDTAAVLL ALATHGRGRR PEVLMDYRTD GYFQCFIGER TPSISTNAHV    360
LETLGHHVAQ HPQDRARYGS AMDTASAWLL AAQKQDGSWL DKWHASPYYA TVCCTQALAA    420
HASPATAPAR QRAVRWVLAT QRSDGGWGLW HSTVEETAYA LQILAPPSGG GNIPVQQALT    480
RGRARLCGAL PLTPLWHDKD LYTPVRVVRA ARAAALYTTR DLLLPPL                  527
```

SEQ ID NO: 37

```
atgaacgccc tatccgaaca cattttgtct gaattgagaa gattattgtc tgaaatgagt     60
gatggcggat ctgttggtcc atctgtgtat gatacggccc aggccctaag attccacggt    120
aacgtaacag gtagacaaga tgcatatgct tggttgatcg cccagcaaca agcagatgga    180
ggttgggct ctgccgactt tccactcttt agacatgctc caacatgggc tgcacttctc    240
gcattacaaa gagctgatcc acttcctggc gcagcagacg cagttcagac cgcaacaaga    300
ttcttgcaaa gacaaccaga tccatacgct catgccgttc tgaggatgc ccctattggt    360
```

TABLE 10-continued

Sequences disclosed herein.

```
gctgaactga tcttgcctca gttttgtgga gaggctgctt ggttgttggg aggtgtggcc   420
ttccctagac acccagccct attaccatta agacaggctt gtttagtcaa actgggtgca   480
gtcgccatgt tgccttcagg acacccattg ctccactcct gggaggcatg gggtacttct   540
ccaacaacag cctgtccaga cgatgatggt tctataggta tctccaccagc agctacagcc   600
gcctggagag cccaggctgt gaccagaggc tcaactcctc aagtgggcag agctgacgca   660
tacttacaaa tggcttcaag agcaacgaga tcaggcatag aaggagtctt ccctaatgtt   720
tggcctataa acgtattcga accatgctgg tcactgtaca ctctccatct tgccggtctg   780
ttcgcccatc cagcactggc tgaggctgta agagttatcg ttgctcaact gaagcaaga   840
ttgggagtgc atggcctcgg accagcttta cattttgctg ccgacgctga tgatactgca   900
gttgcctatt gcgttctgca tttggctggc agagatcctg cagttgacgc attgagacat   960
tttgaaattg gtgagctctt tgttacattc ccaggagaga gaaatgctag tgtctctacg  1020
aacattcacg ctcttcatgc tttgagattg ttaggtaaac cagctgccgg agcaagtgca  1080
tacgtcgaag caaatagaaa tccacatggt tgtgggaca acgaaaaatg gcacgtttca  1140
tggctttatc caactgcaca cgccgttgca gctctagctc aaggcaagcc tcaatggaga  1200
gatgaaagag cactagccgc tctactacaa gctcaaagag atgatggtgg ttggggagct  1260
ggtagaggat ccactttcga ggaaaccgcc tacgctcttt tcgctttaca cgttatggac  1320
ggatctgagg aagccacagg cagaagaaga atcgctcaag tcgtcgcaag agccttagaa  1380
tggatgctag ctagacatgc cgcacatgga ttaccacaaa caccactctg gattggtaag  1440
gaattgtact gtcctactag agtcgtaaga gtagctgagc tagctggcct gtggttagca  1500
ttaagatggg gtagaagagt attagctgaa ggtgctggtc ctgcacccta a           1551
```

SEQ ID NO: 38

```
MNALSEHILS ELRRLLSEMS DGGSVGPSVY DTAQALRFHG NVTGRQDAYA WLIAQQQADG    60
GWGSADFPLF RHAPTWAALL ALQRADPLPG AADAVQTATR FLQRQPDPYA HAVPEDAPIG   120
AELILPQFCG EAAWLLGGVA FPRHPALLPL RQACLVKLGA VAMLPSGHPL LHSWEAWGTS   180
PTTACPDDDG SIGISPAATA AWRAQAVTRG STPQVGRADA YLQMASRATR SGIEGVFPNV   240
WPINVFEPCW SLYTLHLAGL FAHPALAEAV RVIVAQLEAR LGVHGLGPAL HFAADADDTA   300
VALCVLHLAG RDPAVDALRH FEIGELFVTF PGERNASVST NIHALHALRL LGKPAAGASA   360
YVEANRNPHG LWDNEKWHVS WLYPTAHAVA ALAQGKPQWR DERALAALLQ AQRDDGGWGA   420
GRGSTFEETA YALFALHVMD GSEEATGRRR IAQVVARALE WMLARHAAHG LPQTPLWIGK   480
ELYCPTRVVR VAELAGLWLA LRWGRRVLAE GAGAAP                             516
```

SEQ ID NO: 39

```
atggttttgt cttcttcttg tactacagta ccacacttat cttcattagc tgtcgtgcaa    60
cttggtcctt ggagcagtag gattaaaaag aaaaccgata ctgttgcagt accagccgct   120
gcaggaaggt ggagaagggc cttggctaga gcacagcaca catcagaatc cgcagctgtc   180
gcaaagggca gcagtttgac ccctatagtg agaactgacg ctgagtcaag agaacaaga   240
tggccaaccg atgacgatga cgccgaacct ttagtggata agatcagggc aatgcttact   300
tccatgtctg atggtgacat ttccgtgagc gcatacgata cagcctgggt cggattggtt   360
ccaagattag acgcggtga aggtcctcaa tttccagcag ctgtgagatg gataagaaat   420
aaccagttgc tgacggaag ttggggcgat gccgcattat tctctgccta tgacaggctt   480
atcaataccc ttgcctgcgt tgtaactttg acaaggtggt ccctagaacc agagatgaga   540
ggtagaggac tatctttttt gggtaggaac atgtggaaat tagcaactga agatgaagag   600
tcaatgccta ttggcttcga attagcattt ccatctttga tagagcttgc taagagccta   660
ggtgtccatg acttccctta tgatcaccag gccctacaag aatctactc ttcaagagag   720
atcaaaatga agaggattcc aaaagaagtg atgcatacccg ttccaacatc aatattgcac   780
agtttggagg gtatgcctgg cctagattgg gctaaaactac ttaaactaca gagcagcgac   840
ggaagttttt tgttctcacc agctgccact gcatatgctt taatgaatac cggagatgac   900
aggtgtttta gctacatcga tagaacagta aagaaattca acggcggcgt ccctaatgtt   960
tatccagtgg atctatttga acatatttgg gccgttgata gacttgaaag attaggaatc  1020
tccaggtact tccaaaagga gatcgaacaa tgcatggatt atgtaaacag gcattggact  1080
gaggacggta tttgttggc aaggaactct gatgtcaaag aggtggacga cacagctatg  1140
gcctttagac ttcttaggtt gcacggctac agcgtcagtc ctgatgtgtt taaaaacttc  1200
gaaaaggacg gtgaatttt cgcatttgtc ggacagtcta atcaagctgt taccggtatg  1260
tacaacttaa acagacgaag ccagatatcc ttcccaggcg atggtgct tcatagagct  1320
ggtgccttct catatgagtt cttgaggaga aaagaagcag agggagcttt gagggacaag  1380
tggatcattt ctaaagatct acctggtgaa gttgtgtata ctttggattt tccatggtac  1440
ggcaacttac ctagagtcga ggccagagac tacctagagc aatacggagg tggtgatgac  1500
gtttggattg gcaagacatt gtataggatg ccacttgtaa acaatgatgt atatttggaa  1560
ttggcaagaa tggatttcaa ccactgccag gctttgcatc agttagagtg gcaaggacta  1620
aaaagatggt atactgaaaa taggttgatg gactttggtg tcgcccaaga agatgccctt  1680
agacttatt tccttgcagc cgcatctgtt tacgagcctt gtagagctgc cgagaggctt  1740
gcatgggcta gagccgcaat actagctaac gccgtgagca cccacttaag aaatagccca  1800
tcattcagag aaaaggttaga gcattctctt aggtagtagac ctagtgaaga gacagatggc  1860
tcctggttta actcctcaag tggctctgat gcagtttag taaaggctgt cttaagactt  1920
actgattcat tagccaggga agcacagcca atccatggaa gtgacccaga agatattata  1980
cacaagttgt taagatctgc ttgggccgag tgggttaggg aaaagcaga cgctgccgat  2040
agcgtgtgca atggtagttc tgcagtagaa aagagggat caagaatggt ccatgataaa  2100
cagacctgtc tattattggc tagaatgatc gaaatttctg ccggtagggc agctggtgaa  2160
gcagccagtg aggacgcga tagaagaata attcaattaa caggctccat ctgcgacagt  2220
cttaagcaaa aaatgctagt ttcacaggac cctgaaaaaa atgaagagat gatgtctcac  2280
gtggatgacg aattgaagtt gaggattaga gagttcgttc aatatttgct tagactaggt  2340
gaaaaaaaga ctggatctag cgaaaccagg caaacatttt taagtatagt gaaatcatgt  2400
tactatgctg ctcattgccc acctcatgtc gttgatagac acattagtag agtgattttc  2460
gagccagtaa gtgccgcaaa gtaaccgcgg                                    2490
```

TABLE 10-continued

Sequences disclosed herein.

SEQ ID NO: 40

| | | | | | |
|---|---|---|---|---|---|
| MVLSSSCTTV | PHLSSLAVVQ | LGPWSSRIKK | KTDTVAVPAA | AGRWRRALAR | AQHTSESAAV | 60
| AKGSSLTPIV | RTDAESRRTR | WPTDDDDAEP | LVDEIRAMLT | SMSDGDISVS | AYDTAWVGLV | 120
| PRLDGGEGPQ | FPAAVRWIRN | NQLPDGSWGD | AALFSAYDRL | INTLACVVTL | TRWSLEPEMR | 180
| GRGLSFLGRN | MWKLATEDEE | SMPIGFELAF | PSLIELAKSL | GVHDFPYDHQ | ALQGIYSSRE | 240
| IKMKRIPKEV | MHTVPTSILH | SLEGMPGLDW | AKLLKLQSSD | GSFLFSPAAT | AYALMNTGDD | 300
| RCFSYIDRTV | KKFNGGVPNV | YPVDLFEHIW | AVDRLERLGI | SRYFQKEIEQ | CMDYVNRHWT | 360
| EDGICWARNS | DVKEVDDTAM | AFRLLRLHGY | SVSPDVFKNF | EKDGEFFAFV | GQSNQAVTGM | 420
| YNLNRASQIS | FPGEDVLHRA | GAFSYEFLRR | KEAEGALRDK | WIISKDLPGE | VVYTLDFPWY | 480
| GNLPRVEARD | YLEQYGGGDD | VWIGKTLYRM | PLVNNDVYLE | LARMDFNHCQ | ALHQLEWQGL | 540
| KRWYTENRLM | DFGVAQEDAL | RAYFLAAASV | YEPCRAAERL | AWARAAILAN | AVSTHLRNSP | 600
| SFRERLEHSL | RCRPSEETDG | SWFNSSSGSD | AVLVKAVLRL | TDSLAREAQP | IHGGDPEDII | 660
| HKLLRSAWAE | WVREKADAAD | SVCNGSSAVE | QEGSRMVHDK | QTCLLLARMI | EISAGRAAGE | 720
| AASEDGDRRI | IQLTGSICDS | LKQKMLVSQD | PEKNEEMMSH | VDDELKLRIR | EFVQYLLRLG | 780
| EKKTGSSETR | QTFLSIVKSC | YYAAHCPPHV | VDRHISRVIF | EPVSAAK | | 827

SEQ ID NO: 41

| | | | | | |
|---|---|---|---|---|---|
| cttcttcact | aaatacttag | acagagaaaa | cagagctttt | taaagccatg | tctcttcagt | 60
| atcatgttct | aaactccatt | ccaagtacaa | cctttctcag | ttctactaaa | acaacaatat | 120
| cttcttcttt | ccttaccatc | tcaggatctc | ctctcaatgt | cgctagagac | aaatccagaa | 180
| gcggttccat | acattgttca | aagcttcgaa | ctcaagaata | cattaattct | caagaggttc | 240
| aacatgattt | gcctctaata | catgagtggc | aacagcttca | aggagaagat | gctcctcaga | 300
| ttagtgttgg | aagtaaatagt | aatgcattca | aagaagcagt | gaagagtgtg | aaaacgatct | 360
| tgagaaacct | aacggacggg | gaaattacga | tatcggctta | cgatacagct | tgggttgcat | 420
| tgatcgatgc | cggagataaa | actccggcgt | ttccctccgc | cgtgaaatgg | atcgccgaga | 480
| accaactttc | cgatggttct | tggggagatg | cgtatctctt | ctcttatcat | gatcgtctca | 540
| tcaataccct | tgcatgcgtc | gttgctcaaa | gatcatggaa | tctcttttcct | catcaatgca | 600
| acaaaggaat | cacgtttttc | cgggaaaata | ttgggaagct | agaagacgaa | aatgatgagc | 660
| atatgccaat | cggattcgaa | gtagcattcc | catcgttgct | tgagatagct | cgaggaataa | 720
| acattgatgt | accgtacgat | tctccggtct | taaaagatat | atacgccaag | aagagctaa | 780
| agcttacaag | gataccaaaa | gagataatgc | acaagatacc | aacaacattg | ttgcatagtt | 840
| tggaggggat | gcgtgattta | gattgggaaa | agctcttgaa | acttcaatct | caagacggat | 900
| cttttcctctt | ctctccttcc | tctaccgctt | ttgcattcat | gcagaccgca | gacagtaact | 960
| gcctcgagta | ttttgcgaaat | gccgtcaaac | gttttcaatgg | aggagttccc | aatgtcttct | 1020
| ccgtggatct | ttttcgagcac | atatggatag | tggatcggtt | acaacgtttta | gggatatcga | 1080
| gatactttga | agaagagatt | aaagagtgtc | ttgactatgt | ccacagatat | tggaccgaca | 1140
| atggcatatg | ttgggctaga | tgttcccatg | tccaagacat | cgatgataca | gccatggcat | 1200
| ttaggctctt | aagacaacat | ggataccaag | ttccgcaga | tgtattcaag | aactttgaga | 1260
| aagagggaga | gttttttctgc | tttgtgggc | aatcaaacca | agcagtaacc | ggtatgttca | 1320
| acctataccg | ggcatcacaa | ttggcgttttc | caagggaaga | gatattgaaa | acgccaaag | 1380
| agttttctta | taattatctg | ctagaaaaac | gggagagaga | ggagttgatt | gataagtgga | 1440
| ttataatgaa | agacttacct | ggcgagattg | ggttgcgtt | agagattcca | tggtacgcaa | 1500
| gcttgcctcg | agtagagacg | agattctata | ttgatcaata | tggtgagaa | aacgacgttt | 1560
| ggattggcaa | gactctttat | aggatgccat | acgtgaacaa | taatggatat | ctggaattag | 1620
| caaaacaaga | ttacaacaat | tgccaagctc | agcatcagct | cgaatgggac | atattccaaa | 1680
| agtggtatga | agaaaatagg | ttaagtgagt | ggggtgtgcg | cagaagtgag | cttctcggat | 1740
| gttactactt | agcggctgca | actatatttg | aatcagaaag | gtcacatgag | agaatggttt | 1800
| gggctaagtc | aagtgtattg | gttaaagcca | tttcttcttc | ttttgggaa | tcctctgact | 1860
| ccagaagaag | cttctccgat | cagtttcatg | aatacattgc | caatgctcga | cgaagtgatc | 1920
| atcactttaa | tgacaggaac | atgagattgg | accgaccagg | atcggttcag | gccagtcggc | 1980
| ttgccggagt | gttaatcggg | actttgaatc | aaatgtcttt | tgacctttc | atgtctcatg | 2040
| gccgtgacgt | taacaatctc | ctctatctat | cgtggggaga | ttggatggca | aaatggaaac | 2100
| tatatggaga | tgaaggagaa | ggagagctca | tggtgaagat | gataattcta | atgaagaaca | 2160
| atgacctaac | taacttcttc | acccacactc | acttcgttcg | tctcgcggaa | atcatcaatc | 2220
| gaatctgtct | tcctcgccaa | tacttaaagg | caaggagaaa | cgatgagaag | gagaagacaa | 2280
| taaagagtat | ggagaaggag | atggggaaaa | tggttgagtg | agcattgtcg | gagagtgaca | 2340
| catttcgtga | cgtcagcatc | acgtttcttg | atgtagcaaa | agcattttac | tactttgctt | 2400
| tatgtggcga | tcatctccaa | actcacatct | ccaaagtctt | gtttcaaaaa | gtctagtaac | 2460
| ctcatcatca | tcatcgatcc | attaacaatc | agtggatcga | tgtatccata | gatgcgtgaa | 2520
| taatatttca | tgtagagaag | gagaacaaat | tagatcatgt | agggttatca | | 2570

SEQ ID NO: 42

| | | | | | |
|---|---|---|---|---|---|
| MSLQYHVLNS | IPSTTFLSST | KTTISSSFLT | ISGSPLNVAR | DKSRSGSIHC | SKLRTQEYIN | 60
| SQEVQHDLPL | IHEWQQLQGE | DAPQISVGSN | SNAFKEAVKS | VKTILRNLTD | GEITISAYDT | 120
| AWVALIDAGD | KTPAFPSAVK | WIAENQLSDG | SWGDAYLFSY | HDRLINTLAC | VVALRSWNLF | 180
| PHQCNKGITF | FRENIGKLED | ENDEHMPIGF | EVAFPSLLEI | ARGINIDVPY | DSPVLKDIYA | 240
| KKELKLTRIP | KEIMHKIPTT | LLHSLEGMRD | LDWEKLLKLQ | SQDGSFLFSP | SSTAFAFMQT | 300
| RDSNCLEYLR | NAVKRFNGGV | PNVFPVDLFE | HIWIVDRLQR | LGISRYFEEE | IKECLDYVHR | 360
| YWTDNGICWA | RCSHVQDIDD | TAMAFRLLRQ | HGYQVSADVF | KNFEKEGEFF | CFVGQSNQAV | 420
| TGMFNLYRAS | QLAFPREEIL | KNAKEFSYNY | LLEKREREEL | IDKWIIMKDL | PGEIGFALEI | 480
| PWYASLPRVE | TRFYIDQYGG | ENDVWIGKTL | YRMPYVNNNG | YLELAKQDYN | NCQAQHQLEW | 540
| DIFQKWYEEN | RLSEWGVRRS | ELLECYYLAA | ATIFESERSH | ERMVWAKSSV | LVKAISSSFG | 600
| ESSDSRRSFS | DQFHEYIANA | RRSDHHFNDR | NMRLDRPGSV | QASRLAGVLI | GTLNQMSFDL | 660
| FMSHGRDVNN | LLYLSWGDWM | EKWKLYGDEG | EGELMVKMII | LMKNNDLTNF | FTHTHFVRLA | 720

TABLE 10-continued

Sequences disclosed herein.

| | | | | | |
|---|---|---|---|---|---|
| EIINRICLPR | QYLKARRNDE | KEKTIKSMEK | EMGKMVELAL | SESDTFRDVS | ITFLDVAKAF | 780 |
| YYFALCGDHL | QTHISKVLFQ | KV | | | | 802 |

SEQ ID NO: 43

```
atgaatttga gtttgtgtat agcatctcca ctattgacca aatctaatag accagctgct   60
ttatcagcaa ttcatacagc tagtacatcc catggtggcc aaaccaaccc tacgaatctg  120
ataatcgata cgaccaagga gagaatacaa aaacaattca aaaatgttga aatttcagtt  180
tcttcttatg atactgcgtg ggttgccatg gttccatcac ctaattctcc aaagtctcca  240
tgtttcccag aatgtttgaa ttggctgatt aacaaccagt tgaatgatgg atcttggggt  300
ttagtcaatc acacgcacaa tcacaaccat ccacttttga aagattcttt atcctcaact  360
ttggcttgca tcgtggccct aaagagatgg aacgtaggtg aggatcagat taacaagggg  420
cttagtttca ttgaatctaa cttggcttcc gcgactgaaa aatctcaacc atctccaata  480
ggattcgata tcatctttcc aggtctgtta gagtacgcca aaaatctaga tatcaactta  540
ctgtctaagc aaactgattt ctcactaatg ttaacaaaga gagaattaga acaaaagaga  600
tgtcattcaa acgaaatgga tggttaccta gcttatatct ctgaaggtct tggtaatctt  660
tacgattgga atatggtgaa aaagtaccag atgaaaaatg gctcagtttt caattcccct  720
tctgcaactg cggcagcatt cattaaccat caaaatccag gatgcctgaa ctatttgaat  780
tcactactag acaaattcgg caacgcagtt ccaactgtat accctcacga tttgtttatc  840
agattgagta tggtggatac aattgaaaga cttggtatat cccaccactt tagagtcgag  900
atcaaaaatg ttttggatga gacataccgt tgttgggtgg agagagatga acaaatcttt  960
atggatgttg tgacgtgcgc gttggccttt agattgttgc gtattaacgg ttacgaagtt 1020
agtccagatc cacttgccga aattacaaac gaattagctt taaaggatga atacgccgct 1080
cttgaaacat atcatgcgtc acatatcctt taccaagagg acttatcatc tggaaaacaa 1140
attcttaaat ctgctgattt cctgaaggaa atcatatcca ctgatagtaa tagactgtcc 1200
aaactgatcc ataagaggt tgaaaatgca cttaagttcc ctattaacac cggcttagaa 1260
cgtattaaca caagacgtaa catccagctt tacaacgtag acaatactag aatcttgaaa 1320
accacttacc attcttccaa catatcaaac actgattacc taagattagc tgttgaagat 1380
ttctacacat gtcagtctat ctatagaaa gagctgaaag gattagagag atgggtcgtt 1440
gagaataagc tagatcaatt gaaatttgcc agacaaaaga cagcttattg ttacttctca 1500
gttgccgcca ctttatcaag tccagaattg tcagatgcac gtatttcttg ggctaaaaac 1560
ggaatttga caactgttgt tgatgatttc tttgatattg gcgggacaat cgacgaattg 1620
acaaacctga ttcaatgcgt tgaaaagtgg aatgtcgatg tcgataaaga ctgttgctca 1680
gaacatgtta aatactgtt cttggctctg aaagatgcta tctgttggat cggggatgag 1740
gctttcaaat ggcaagctag agatgtgacg tctcacgtca ttcaaacctg gctagaactg 1800
atgaactcta tgttgagaga agcaatttgg actagagatg tatacgttcc tacattaaac 1860
gagtatatgg aaaacgctta tgtctccttt gctttgggtc ctatcgttaa gcctgccata 1920
tactttgtag gaccaaagct atccgaggaa atcgtcgaat catcagaata ccataacttg 1980
ttcaagttaa tgtccacaca aggcagatta cttaatgata ttcattcttt caaaagagag 2040
tttaaggaag gaaagttaaa tgctgttgct cttcatcttt ctaatggcga aagtggtaaa 2100
gtcgaagagg aagtagttga ggaaatgatg atgatgatca aaaacaagag aaaggagttg 2160
atgaaactaa tcttcgaaga aacggttca attgttccta gagcatgtaa ggatgcattt 2220
tggaacatgt gtcatgtgct aaacttttc tacgcaaacg acgatggttt tactgggaac 2280
acaatactag atacagtaaa agacatcata tacacccct tggtcttagt aaacgaaaac 2340
gaggagcaaa gataa                                                 2355
```

SEQ ID NO: 44

| | | | | | |
|---|---|---|---|---|---|
| MNLSLCIASP | LLTKSNRPAA | LSAIHTASTS | HGGQTNPTNL | IIDTTKERIQ | KQFKNVEISV | 60 |
| SSYDTAWVAM | VPSPNSPKSP | CFPECLNWLI | NNQLNDGSWG | LVNHTHNHNH | PLLKDSLSST | 120 |
| LACIVALKRW | NVGEDQINKG | LSFIESNLAS | ATEKSQPSPI | GFDIIFPGLL | EYAKNLDINL | 180 |
| LSKQTDFSLM | LHKRELEQKR | CHSNEMDGYL | AYISEGLGNL | YDWNMVKKYQ | MKNGSVFNSP | 240 |
| SATAAAFINH | QNPGCLNYLN | SLLDKFGNAV | PTVYPHDLFI | RLSMVDTIER | LGISHHFRVE | 300 |
| IKNVLDETYR | CWVERDEQIF | MDVVTCALAF | RLLRINGYEV | SPDPLAEITN | ELALKDEYAA | 360 |
| LETYHASHIL | YQEDLSSGKQ | ILKSADFLKE | IISTDSNRLS | KLIHKEVENA | LKFPINTGLE | 420 |
| RINTRRNIQL | YNVDNTRILK | TTYHSSNISN | TDYLRLAVED | FYTCQSIYRE | ELKGLERWVV | 480 |
| ENKLDQLKFA | RQKTAYCYFS | VAATLSSPEL | SDARISWAKN | GILTTVVDDF | FDIGGTIDEL | 540 |
| TNLIQCVEKW | NVDVDKDCCS | EHVRILFLAL | KDAICWIGDE | AFKWQARDVT | SHVIQTWLEL | 600 |
| MNSMLREAIW | TRDAYVPTLN | EYMENAYVSF | ALGPIVKPAI | YFVGPKLSEE | IVESSEYHNL | 660 |
| FKLMSTQGRL | LNDIHSFKRE | FKEGKLNAVA | LHLSNGESGK | VEEEVVEEMM | MMIKNKRKEL | 720 |
| MKLIFEENGS | IVPRACKDAF | WNMCHVLNFF | YANDDGFTGN | TILDTVKDII | YNPLVLVNEN | 780 |
| EEQR | | | | | | 784 |

SEQ ID NO: 45

```
atgaatctgt ccctttgtat agctagtcca ctgttgacaa atcttctag accaactgct   60
ctttctgcaa ttcatactgc cagtactagt catggaggtc aaacaaaccc aacaaatttg  120
ataatcgata ctactaagga gagaatccaa aagctattca aaaatgttga aatctcagta  180
tcatcttatg acaccgcatg ggttgcaatg gtgccatcac ctaattccc aaaaagtcca  240
tgttttccag agtgcttgaa ttggttaatc aataatcagt taaacgatgg ttcttgggt  300
ttagtcaacc acactcataa ccacaatcat ccattattga aggactcttt atcatcaaca  360
ttagcctgta ttgttgcatt gaaagatgg aatgtaggtg aagatcaaat caacaagggg  420
ttatcattca tagaatccaa tctagcttct gctaccgaca aatcacaacc atctccaatc  480
gggttcgaca taatcttccc tggtttgctg gagtatgcca aaaaccttga tatcaactta  540
ctgtctaaac aaacagattt ctctttgatg ctacacaaaa gagagttaga gcagaaaaga  600
tgccattcta acgaaattga cgggactta gcatatatct cagaaggttt gggtaattg  660
tatgactgga acatggtcaa aaagtatcag atgaaaaatg gatccgtatt caattctcct  720
tctgcaactg ccgcagcatt cattaatcat caaaaccctg gtgtcttaa ctacttgaac  780
```

TABLE 10-continued

Sequences disclosed herein.

```
tcactattag ataagtttgg aaatgcagtt ccaacagtct atcctttgga cttgtacatc    840
agattatcta tggttgacac tatagagaga ttaggtattt ctcatcattt cagagttgag    900
atcaaaaatg ttttggacga gacatacaga tgttgggtcg aaagagatga gcaaatcttt    960
atggatgtcg tgacctgcgc tctggctttt agattgctaa ggatacacgg atacaaagta   1020
tctcctgatc aactggctga gattacaaac gaactggctt caaagacga atacgccgca    1080
ttagaaacat accatgcatc ccaaatactt taccaggaag acctaagttc aggaaaacaa   1140
atcttgaagt ctgcagattt cctgaaaggc attctgtcta cagatagtaa taggttgtct   1200
aaattgatac acaaggaagt agaaaacgca ctaaagtttc ctattaacac tggtttagag   1260
agaatcaata ctaggagaaa cattcagctg tacaacgtag ataatacaag gattcttaag   1320
accacctacc atagttcaaa catttccaac acctattact taagattagc tgtcgaagac   1380
ttttacactt gtcaatcaat ctacagagag gagttaaagg gcctagaaag atgggtagtt   1440
caaaacaagt tggatcaact gaagtttgct agacagaaga cagcatactg ttatttctct   1500
gttgctgcta ccctttcatc cccagaattg tctgatgcca gaataagttg ggccaaaaat   1560
ggtattctta caactgtagt cgatgatttc tttgatattg gaggtactat tgatgaactg   1620
acaaatctta ttcaatgtgt tgaaaagtgg aacgtggata tagataagga ttgctgcagt   1680
gaacatgtga gaatactttt cctggctcta aaagatgcaa tatgttggat tggcgacgag   1740
gccttcaagt ggcaagctag agatgttaca tctcatgtca tccaaacttg gcttgaactg   1800
atgaactcaa tgctaagaga agcaatctgg acaagagatg catacgttcc aacattgaac   1860
gaatacatgg aaaacgctta cgtctcattt gccttggtc ctattgttaa gccagccata   1920
tactttgttg ggccaaagtt atccgaagag attgttgagt cttccgaata tcataaccta   1980
ttcaagttaa tgtcaacaca aggcagactt ctgaacgata tccactcctt caaaagagaa   2040
ttcaaggaag gtaagctaaa cgctgttgct ttgcacttgt ctaatggtga atctggcaaa   2100
gtggaagagg aagtcgttga ggaaatgatg atgatgataa aaaacaagag aaaggaattg   2160
atgaaattga ttttcgagga aaatggttca atcgtaccta gagcttgtaa aaatgctttt   2220
tggaatatgt gccatgttct taacttcttt tacgctaatg atgatggctt cactggaaat   2280
acaatattgg atacagttaa agatatcatc tacaacccac ttgttttggt caatgagaac   2340
gaggaacaaa gataa                                                    2355
```

SEQ ID NO: 46

```
MNLSLCIASP LLTKSSRPTA LSAIHTASTS HGGQTNPTNL IIDTTKERIQ KLFKNVEISV    60
SSYDTAWVAM VPSPNSPKSP CFPECLNWLI NNQLNDGSWG LVNHTHNHNH PLLKDSLSST   120
LACIVALKRW NVGEDQINKG LSFIESNLAS ATDKSQPSPI GFDIIFPGLL EYAKNLDINL   180
LSKQTDFSLM LHKRELEQKR CHSNEIDGYL AYISEGLGNL YDWNMVKKYQ MKNGSVFNSP   240
SATAAAFINH QNPGCLNYLN SLLDKFGNAV PTVYPLDLYI RLSMVDTIER LGISHHFRVE   300
IKNVLDETYR CWVERDEQIF MDVVTCALAF RLLRIHGYKV SPDQLAEITN ELAFKDEYAA   360
LETYHASQIL YQEDLSSGKQ ILKSADFLKG ILSTDSNRLS KLIHKEVENA LKFPINTGLE   420
RINTRRNIQL YNVDNTRILK TTYHSSNISN TYYLRLAVED FYTCQSIYRE ELKGLERWVV   480
QNKLDQLKFA RQKTAYCYFS VAATLSSPEL SDARISWAKN GILTTVVDDF FDIGGTIDEL   540
TNLIQCVEKW NVDVDKDCCS EHVRILFLAL KDAICWIGDE APFKWQARDVT SHVIQTWLEL   600
MNSMLREAIW TRDAYVPTLN EYMENAYVSF ALGPIVKPAI YFVGPKLSEE IVESSEYHNL   660
FKLMSTQGRL LNDIHSFKRE FKEGKLNAVA LHLSNGESGK VEEEVVEEMM MMIKNKRKEL   720
MKLIFEENGS IVPRACKDAF WNMCHVLNFF YANDDGFTGN TILDTVKDII YNPLVLVNEN   780
EEQR                                                                784
```

SEQ ID NO: 47

```
atggctatgc cagtgaagct aacacctgcg tcattatcct taaaagctgt gtgctgcaga     60
ttctcatccg gtggccatgc tttgagattc gggagtagtc tgccatgttg gagaaggacc    120
cctacccaaa gatctactt ttcctctact actagaccag ctgccgaagt gtcatcaggt     180
aagagtaaac aacatgatca ggaagctagt gaagcgacta tcagacaaca attcaacttt    240
gtggatgtcc tggagaatat gggaatatcc agacattttg ctgcagagat aaagtgcata    300
ctagacagaa cttacagatc ttggttacaa agacacgagg aaatcatgct ggacactatg    360
acatgtgcta tggcttttag aatcctaaga ttgaacggat acaacgttc atcagatgaa    420
ctataccacg ttgtagaggc atctggtctg cataattctt gggtgggta tcttaacgat    480
accagaacac tacttgaatt acacaaggct tcaacagtta gtatctctga ggatgaatct    540
atcttagatt caattggctc tagatccaga acattgctta ggaacaatt ggagtctgt     600
ggcgcactga gaaagccttc tttattcaaa gaggttgaac atgcactgga tggaccttt     660
tacaccacac ttgatagact tcatcatagg tggaatattg aaaacttcaa cattattgag    720
caacacatgt tggagactcc atacttatct aaccagcata catcaaggga tatcctagca    780
ttgtcaatta gagatttttc ctcctcacaa ttcacttatc aacaagagct acagcattcg    840
gagagttggg ttaaggaatg tagattagat caactacagt tcgcaagaca gaaattagcg    900
tacttttacc tatcagccgc aggcaccatg ttttctcctg agcttctga tgcgagaaca    960
ttatgggcca aaaacggggt gttgacaact attgttgatg atttctttga tgttgccggt   1020
tctaaagagg aattggaaaa cttagtcatg ctggtcgaaa tgtgggatga acatcacaaa   1080
gttgaattct attctgagca ggtcgaaatc atcttctctt ccatctacga ttctgtcaac   1140
caattgggtg agaaggcctc tttggttcaa gacagatcaa ttacaaaca ccttgttgaa   1200
atatggttag acttgttaaa gtccatgatg acgaagttg aatggagact gtcaaaatac   1260
gtgcctacag aaaaggaata catgattaat gcctctctta tcttcggcct aggtccaatc   1320
gttttaccag ctttgtattt cgttggtcca aagatttcag aaagtatagt aaaggaccca   1380
gaatatgatg aattgttcaa actaatgtca acatgtggta gattgttgaa tgacgtgcaa   1440
acgttcgaaa gagaatacaa tagggtaaa ctgaattctg tcagctctatt ggttcttcac   1500
ggaggcccaa tgtctatttc agacgcaaag aggaaattac aaaagcctat tgatacgtgt   1560
agaagagatc ttctttcttt ggtccttaga aagagtctg tagtaccaag accatgtaag   1620
gaactattct ggaaaatgtg taagtgtgc tatttctttt actcaacaac tgatgggttt    1680
tctagtcaag tcgaaagagc aaaagaggta gacgctgtca taaatgagcc actgaagttg   1740
caaggttctc tacactggt atctgatgtt taa                                  1773
```

TABLE 10-continued

Sequences disclosed herein.

SEQ ID NO: 48

| | | | | | | |
|---|---|---|---|---|---|---|
| MAMPVKLTPA | SLSLKAVCCR | FSSGGHALRF | GSSLPCWRRT | PTQRSTSSST | TRPAAEVSSG | 60 |
| KSKQHDQEAS | EATIRQQLQL | VDVLENMGIS | RHFAAEIKCI | LDRTYRSWLQ | RHEEIMLDTM | 120 |
| TCAMAFRILR | LNGYNVSSDE | LYHVVEASGL | HNSLGGYLND | TRTLLELHKA | STVSISEDES | 180 |
| ILDSIGSRSR | TLLREQLESG | GALRKPSLFK | EVEHALDGPF | YTTLDRLHHR | WNIENFNIIE | 240 |
| QHMLETPYLS | NQHTSRDILA | LSIRDFSSSQ | FTYQQELQHL | ESWVKECRLD | QLQFARQKLA | 300 |
| YFYLSAAGTM | FSPELSDART | LWAKNGVLTT | IVDDFFDVAG | SKEELENLVM | LVEMWDEHHK | 360 |
| VEFYSEQVEI | IFSSIYDSVN | QLGEKASLVQ | DRSITKHLVE | IWLDLLKSMM | TEVEWRLSKY | 420 |
| VPTEKEYMIN | ASLIFGLGPI | VLPALYFVGP | KISESIVKDP | EYDELFKLMS | TCGRLLNDVQ | 480 |
| TFEREYNEGK | LNSVSLLVLH | GGPMSISDAK | RKLQKPIDTC | RRDLLSLVLR | EESVVPRPCK | 540 |
| ELFWKMCKVC | YFFYSTTDGF | SSQVERAKEV | DAVINEPLKL | QGSHTLVSDV | | 590 |

SEQ ID NO: 49

| | | | | | | |
|---|---|---|---|---|---|---|
| atgcagaact | tccatggtac | aaaggaaagg | atcaaaaaga | tgtttgacaa | gattgaattg | 60 |
| tccgtttctt | cttatgatac | agcctgggtt | gcaatggtcc | catcccctga | ttgcccagaa | 120 |
| acaccttgtt | ttccagaatg | tactaaatgg | atcctagaaa | atcagttggg | tgatggtagt | 180 |
| tggtcacttc | ctcatggcaa | tccacttcta | gttaaagatg | cattatcttc | cactcttgct | 240 |
| tgtattctgg | ctcttaaaag | atggggaatc | ggtgaggaac | agattaacaa | aggactgaga | 300 |
| ttcatagaac | tcaactctgc | tagtgtaacc | gataacgaac | aacacaaacc | aattggattt | 360 |
| gacattatct | ttccaggtat | gattgaatac | gctatagact | tagacctgaa | tctaccacta | 420 |
| aaaccaactg | acattaactc | catgttgcat | cgtagagccc | ttgaattgac | atcaggtgga | 480 |
| ggcaaaaatc | tagaaggtag | aagagcttac | ttggcctacg | tctctgaagg | aatcggtaag | 540 |
| ctgcaagatt | gggaaatggc | tatgaaatac | caacgtaaaa | acggatctct | gttcaatagt | 600 |
| ccatcaacaa | ctgcagctgc | attcatccat | atacaagatg | ctgaatgcct | ccactatatt | 660 |
| cgttctcttc | tccagaaatt | tggaaacgca | gtccctacaa | tatacctcct | cgatatctat | 720 |
| gccagacttt | caatggtaga | tgccctggaa | cgtcttggta | ttgatagaca | tttcagaaag | 780 |
| gagagaaagt | tcgttctgga | tgaaacatac | agatttggt | tgcaaggaga | gaggagatt | 840 |
| ttctccgata | acgcaacctg | tgcttttggcc | ttcagaatat | tgagacttaa | tggttacgat | 900 |
| gtctctcttg | aagatcactt | ctctaactct | ctgggcggtt | acttaaagga | ctcaggagca | 960 |
| gctttagaac | tgtacagagc | cctccaattg | tcttacccag | acgagtccct | cctggaaaag | 1020 |
| caaaattcta | gaacttctta | cttcttaaaa | caaggtttat | ccaatgtctc | cctctgtggt | 1080 |
| gacagattgc | gtaaaaacat | aattggagag | gtgcatgatg | ctttaaactt | ttccgaccac | 1140 |
| gctaacttac | aaagattagc | tattcgtaga | aggattaagc | attacgctac | tgacgataca | 1200 |
| aggattctaa | aaacttccta | cagatgtcta | acaatccgatt | accaagattt | tctaaaactt | 1260 |
| gcagtggaag | atttcaatat | ctgtcaatca | atacaaagag | aggaattcaa | gcatattgaa | 1320 |
| agatgggtcg | ttgaaagacg | tctagacaag | ttaaagttcg | ctagacaaaa | agaggcctat | 1380 |
| tgctatttct | cagccgcagc | aacattgttt | gcccctgaat | tgtctgatgc | tagaatgtct | 1440 |
| tgggccaaaa | atggtgtatt | gacaactgtg | gttgatgatt | tcttcgatgt | cggaggctct | 1500 |
| gaagaggaat | tagttaactt | gataagaattg | atcgagcgtt | gggatgtgaa | tggcagtgca | 1560 |
| gatttttgta | gtgaggaagt | tgagattatc | tattctgcta | tccactcaac | tatctctgaa | 1620 |
| ataggtgata | agtcatttgg | ctggcaaggt | agagatgtaa | agtctcaagt | tatcaagatc | 1680 |
| tggctggact | tattgaaatc | aatgttaact | gaagctcaat | ggtcttcaaa | caagtctgtt | 1740 |
| cctaccctag | atgagtatat | gacaaccgcc | catgtttcat | tcgcacttgg | tccaattgta | 1800 |
| cttccagcct | tatacttcgt | tggcccaaag | ttgtcagaag | aggttgcagg | tcatcctgaa | 1860 |
| ctactaaacc | tctacaaagt | cacatctact | tgtggcagac | tactgaatga | ttggagaagt | 1920 |
| tttaagagag | aatccgagga | aggtaagctc | aacgctatta | gtttatacat | gatccactcc | 1980 |
| ggtggtgctt | ctacagaaga | ggaaacaatc | gaacatttca | aaggtttgat | tgattctcag | 2040 |
| agaaggcaac | tgttacaatt | ggtgttgcaa | gagaaggata | gtatcatacc | tagaccatgt | 2100 |
| aaagatctat | tttggaatat | gattaagtta | ttacacactt | tctacatgaa | agatgatggc | 2160 |
| ttcacctcaa | atgagatgag | gaatgtagtt | aaggcaatca | ttaacgaacc | aatctcactg | 2220 |
| gatgaattat | ga | | | | | 2232 |

SEQ ID NO: 50

| | | | | | | |
|---|---|---|---|---|---|---|
| MSCIRPWFCP | SSISATLTDP | ASKLVTGEFK | TTSLNFHGTK | ERIKKMFDKI | ELSVSSYDTA | 60 |
| WVAMVPSPDC | PETPCFPECT | KWILENQLGD | GSWSLPHGNP | LLVKDALSST | LACILALKRW | 120 |
| GIGEEQINKG | LRFIELNSAS | VTDNEQHKPI | GFDIIFPGMI | EYAKDLDLNL | PLKPTDINSM | 180 |
| LHRRALELTS | GGGKNLEGRR | AYLAYVSEGI | GKLQDWEMAM | KYQRKNGSLF | NSPSTTAAAF | 240 |
| IHIQDAECLH | YIRSLLQKFG | NAVPTIYPLD | IYARLSMVDA | LERLGIDRHF | RKERKFVLDE | 300 |
| TYRFWLQGEE | EIFSDNATCA | LAFRILRLNG | YDVSLEDHFS | NSLGGYLKDS | GAALELYRAL | 360 |
| QLSYPDESLL | EKQNSRTSYF | LKQGLSNVSL | CGDRLRKNII | GEVHDALNFP | DHANLQRLAI | 420 |
| RRRIKHYATD | DTRILKTSYR | CSTIGNQDFL | KLAVEDFNIC | QSIQREEFKH | IERWVVERRL | 480 |
| DKLKFARQKE | AYCYFSAAAT | LFAPELSDAR | MSWAKNGVLT | TVVDDFFDVG | GSEEELVNLI | 540 |
| ELIERWDVNG | SADFCSEEVE | IIYSAIHSTI | SEIGDKSFGW | QGRDVKSHVI | KIWLDLLKSM | 600 |
| LTEAQWSSNK | SVPTLDEYMT | TAHVSFALGP | IVLPALYFVG | PKLSEEVAGH | PELLNLYKVM | 660 |
| STCGRLLNDW | RSFKRESEEG | KLNAISLYMI | HSGGASTEEE | TIEHFKGLID | SQRRQLLQLV | 720 |
| LQEKDSIIPR | PCKDLFWNMI | KLLHTFYMKD | DGFTSNEMRN | VVKAIINEPI | SLDEL | 775 |

SEQ ID NO: 51

| | | | | | | |
|---|---|---|---|---|---|---|
| atgtctatca | accttcgctc | tccggttgt | tcgtctccga | tctcagctac | tttggaacga | 60 |
| ggattggact | cagaagtaca | gacaagagct | aacaatgtga | gctttgagca | aacaaaggag | 120 |
| aagattagga | gatgttgga | gaaagtggag | ctttctgttt | cggcctacga | tactagttgg | 180 |
| gtagcaatgg | ttccatcacc | gagctcccaa | aatgctccac | ttttcccaca | gtgtgtgaaa | 240 |
| tggttattgg | ataatcaaca | tgaagatgga | tcttgggac | ttgataacca | tgaccatcaa | 300 |
| tctccttaaga | aggatgtgtt | atcatctaca | ctggctagta | tcctgcgtt | aaagaagtgg | 360 |

TABLE 10-continued

Sequences disclosed herein.

```
ggaattggtg aaagacaaat aaacaagggt ctccagttta ttgagctgaa ttctgcatta    420
gtcactgatg aaaccataca gaaaccaaca gggtttgata ttatatttcc tgggatgatt    480
aaatatgcta gagatttgaa tctgacgatt ccattgggct cagaagtggt ggatgacatg    540
atacgaaaaa gagatctgga tcttaaatgt gatagtgaaa agttttcaaa gggaagagaa    600
gcatatctgg cctatgtttt agaggggaca agaaacctaa aagattggga tttgatagtc    660
aaatatcaaa ggaaaaatgg gtcactgttt gattctccag ccacaacagc agctgctttt    720
actcagtttg ggaatgatgg ttgtctccgt tatctctgtt ctctccttca gaaattcgaa    780
gctgcagttc cttcagttta tccatttgat caatatgcac gccttagtat aattgtcact    840
cttgaaagct taggaattga tagagatttc aaaaccgaaa tcaaaagcat attggatgaa    900
acctatagat attggcttcg tggggatgaa gaaatatgtt tggacttggc cacttgtgct    960
ttggctttcc gattattgct tgctcatggc tatgatgtgt cttacgatcc gctaaaacca   1020
tttgcagaag aatctggttt ctctgatact tggaaggat atgttaagaa tacgttttct    1080
gtgttagaat tatttaaggc tgctcaaagt tatccacatg aatcagcttt gaagaagcag   1140
tgttgttgga ctaaacaata tctggagatg gaattgtcca gctgggttaa gacctctgtt   1200
cgagataaat acctcaagaa agaggtcgag gatgctcttg cttttccctc ctatgcaagc   1260
ctagaaagat cagatcacag gagaaaaata ctcaatggtt ctgctgtgga aaacaccaga   1320
gttacaaaaa cctcatatcg tttgcacaat atttgcacct ctgatatcct gaagttagct   1380
gtggatgact tcaatttctg ccagtccata caccgtgaag aaatgggacg tcttgatagg   1440
tggattgtgg agaatagatt gcaggaactg aaatttgcca gacagaagct ggcttactgt   1500
tatttctctg gggctgcaac tttatttttct ccagaactat ctgatgctcg tatatcgtgg   1560
gccaaaggtg gagtacttac aacggttgta gacgactct ttgatgttgg agggtccaaa    1620
gaagaactgg aaaaccctcat acacttggtc gaaaagtggg atttgaacgg tgttcctgag   1680
tacagctcag acatgttga gatcatattc tcagttctaa gggacaccat tctcgaaaca    1740
ggagacaaag cattcaccta tcaaggacgc aatgtgacac accacattgt gaaaatttgg   1800
ttggatctgc tcaagtctat gttgagagaa gccgagtggt ccagtgacaa gtcaacacca   1860
agcttggagg attacatgga aaatgcgtac atatcatttg cattaggacc aattgtcctc   1920
ccagctacct atctgatcgg acctccactt ccagagaaga cagtcgatag ccaccaatat   1980
aatcagctct acaagctcgt gagcactatg ggtcgtcttc taaatgacat acaaggtttt   2040
aagagagaaa gcgcggaagg gaagctgaat gcggtttcat tgcacatgaa acacgagaga   2100
gacaatcgca gcaaagaagt gatcatagaa tcgatgaaag gttagcaga gagaaagagg   2160
gaagaattgc ataagctagt tttggaggag aaaggaagtg tggttccaag ggaatgcaaa   2220
gaagcgttct tgaaaatgag caaagtgttg aacttatttt acaggaagga cgatggattc   2280
acatcaaatg atctgatgag tcttgttaaa tcagtgatct acgagcctgt tagcttacag   2340
aaagaatctt taacttga                                                  2358
```

SEQ ID NO: 52

```
MSINLRSSGC SSPISATLER GLDSEVQTRA NNVSFEQTKE KIRKMLEKVE LSVSAYDTSW     60
VAMVPSPSSQ NAPLFPQCVK WLLDNQHEDG SWGLDNHDHQ SLKKDVLSST LASILALKKW    120
GIGERQINKG LQFIELNSAL VTDETIQKPT GFDIIFPGMI KYARDLNLTI PLGSEVVDDM    180
IRKRDLDLKC DSEKFSKGRE AYLAYVLEGT RNLKDWDLIV KYQRKNGSLF DSPATTAAAF    240
TQFGNDGCLR YLCSLLQKFE AAVPSVYPFD QYARLSIIVT LESLGIDRDF KTEIKSILDE    300
TYRYWLRGDE EICLDLATCA LAFRLLLAHG YDVSYDPLKP FAEESGFSDT LEGYVKNTFS    360
VLELFKAAQS YPHESALKKQ CCWTKQYLEM ELSSWVKTSV RDKYLKKEVE DALAFPSYAS    420
LERSDHRRKI LNGSAVENTR VTKTSYRLHN ICTSDILKLA VDDFNFCQSI HREEMERLDR    480
WIVENRLQEL KFARQKLAYC YFSGAATLFS PELSDARISW AKGGVLTTVV DDFFDVGGSK    540
EELENLIHLV EKWDLNGVPE YSSEHVEIIF SVLRDTILET GDKAFTYQGR NVTHHIVKIW    600
LDLLKSMLRE AEWSSDKSTP SLEDYMENAY ISFALGPIVL PATYLIGPPL PEKTVDSHQY    660
NQLYKLVSTM GRLLNDIQGF KRESAEGKLN AVSLHMKHER DNRSKEVIIE SMKGLAERKR    720
EELHKLVLEE KGSVVPRECK EAFLKMSKVL NLFYRKDDGF TSNDLMSLVK SVIYEPVSLQ    780
KESLT                                                                785
```

SEQ ID NO: 53

```
atggaatttg atgaaccatt ggttgacgaa gcaagatctt tagtgcagcg tactttacaa     60
gattatgatg acagatacgg cttcggtact atgtcatgtg ctgcttatga tacagcctgg    120
gtgtctttag ttacaaaaac agtcgatggg agaaaacaat ggcttttccc aagtgtttt    180
gaatttctac tagaaacaca atctgatgcc ggaggatggg aaatcgggaa ttcagcacca    240
atcgacggta tattgaatac agctgcatcc ttacttgctc taaaacgtca cgttcaaact    300
gagcaaatca tccaacctca acatgaccat aaggatctag caggtagagc tgaacgtgcc    360
gctgcatctt tgagagcaca attggctgca ttggatgtgt ctacaactga acacgtcgat    420
tttgagataa ttgttcctgc aatgctagac ccattagaag ccgaagatcc atctctagtt    480
ttcgattttc cagctaggaa accttgatg aagattcatg atgctaagat gagtagattc    540
aggccagaat acttgtatgg caaacaacca atgaccgcct acattcatt agaggctttc    600
ataggcaaaa tcgacttcga taaggtaaga caccaccgta cccatgggtc tatgatgggt    660
tctccttcat ctaccgcagc ctacttaatg cacgcttcac aatgggatgg tgactcagag    720
gcttaccttta gacacgtgat taaacacgca gcagggcagg gaactggtgc tgtaccatct    780
gctttcccat caacacattt tgagtcatct tggattctta ccacattgtt tagagctgga    840
ttttcagctt ctcatcttgc ctgtgatgag ttgaacaagt ggtcgagat acttgaggc    900
tcattcgaga aggaaggtgg ggcaatcggt tacgctccag ggtttcaagc agatgttgat    960
gatactgcta aaacaataag tacattagca gtccttggaa gagatgctac accaagacaa   1020
atgatcaagg tatttgaagc taatacacat tttagaacat accctggtga agagatcct   1080
tctttacag ctaattgtaa tgctctatca gccttactac accaaccaga tgcagcaatg   1140
tatggatctc aaattcaaaa gattaccaaa tttgtctgtg actattggtg gaagtctgat   1200
ggtaagatta aagataagtg gaacacttgc tacttgtacc catctgtctt attagttgag   1260
gttttggttg atcttgttag tttattggag cagggtaaat tgcctgatgt tttgatcaa   1320
gagcttcaat acagagtcgc catcacattg ttccaagcat gtttaaggcc attactagac   1380
caagatgccg aaggatcatg gaacaagtct atcgaagcca cagcctacgg catccttatc   1440
```

TABLE 10-continued

Sequences disclosed herein.

```
ctaactgaag ctaggagagt ttgtttcttc gacagattgt ctgagccatt gaatgaggca   1500
atccgctagag gtatcgcttt cgccgactct atgtctggca ctgaagctca gttgaactac   1560
atttggatcg aaaaggttag ttacgcacct gcattattga ctaaatccta tttgttagca   1620
gcaagatggg ctgctaagtc tcctttaggc gcttccgtag gctcttcttt gtggactcca   1680
ccaagagaag gattggataa gcatgtcaga ttattccatc aagctgagtt attcagatcc   1740
cttccagaat gggaattaag agcctccatg attgaagcag ctttgttcac accacttcta   1800
agagcacata gactagacgt tttccctaga caagatgtag gtgaagacaa atatcttgat   1860
gtagttccat tcttttggac tgccgctaac aacagagata gaacttacgc ttccactcta   1920
ttcctttacg atatgtgttt tatcgcaatg ttaaacttcc agttagacga attcatggag   1980
gccacagccg gtatcttatt cagagatcat atggatgatt tgaggcaatt gattcatgat   2040
cttttggcag agaaaacttc cccaaagagt tctggtagga gtagtcaggg cacaaaagat   2100
gctgactcag gtatagagga agacgtgtca atgtccgatt cagcttcaga ttcccaggat   2160
agaagtccaa aatacgactt ggttttcagt gcattgagta cctttacaaa acatgtcttg   2220
caacacccat ctatacaaag tgcctctgta tgggatagaa aactacttgc tagagagatg   2280
aaggcttact tacttgctca tatccaacaa gcagaagatt caactccatt gtctgaattg   2340
aaagatgtgc ctcaaaagac tgatgtaaca agagtttcta catctactac taccttcttt   2400
aactgggtta gaacaacttc cgcagaccat atatcctgcc catactcctt ccactttgta   2460
gcatgccatc taggcgcagc attgtcacct aaagggtcta acgtgattg ctatccttca   2520
gctggtgaga agttcttggc agctgcagtc tgcagacatt tggccaccat gtgtagaatg   2580
tacaacgatc ttggatcagc tgaacgtgat tctgatgaag gtaatttgaa ctccttggac   2640
ttccctgaat cgccgattc cgcaggaaac ggagggataa aaattcagaa ggccgctcta   2700
ttaaggttag ctgagtttga gagagattca tacttagagg ccttccgtcg tttacaagat   2760
gaatccaata gagttcacgg tccagccggt ggtgatgaag ccagattgtc cagaaggaga   2820
atggcaatcc ttgaattctt cgcccagcag gtagatttgt acggtcaagt atacgtcatt   2880
agggatattt ccgctcgtat tcctaaaaac gaggttgaga aaaagagaaa attggatgat   2940
gctttcaatt ga                                                        2952
```

SEQ ID NO: 54

```
MEFDEPLVDE ARSLVQRTLQ DYDDDRYGFGT MSCAAYDTAW VSLVTKTVDG RKQWLFPECF    60
EFLLETQSDA GGWEIGNSAP IDGILNTAAS LLALKRHVQT EQIIQPQHDH KDLAGRAERA   120
AASLRAQLAA LDVSTTEHVG FEIIVPAMLD PLEAEDPSLV FDFPARKPLM KIHDAKMSRF   180
RPEYLYGKQP MTALHSLEAF IGKIDFDKVR HHRTHGSMMG SPSSTAAYLM HASQWDGDSE   240
AYLRHVIKHA AGQGTGAVPS AFPSTHFESS WILTTLFRAG FSASHLACDE LNKLVEILEG   300
SFEKEGGAIG YAPGFQADVD DTAKTISTLA VLGRDATPRQ MIKVFEANTH FRTYPGERDP   360
SLTANCNALS ALLHQPDAAM YGSQIQKITK FVCDYWWKSD GKIKDKWNTC YLYPSVLLVE   420
VLVDLVSLLE QGKLPDVLDQ ELQYRVAITL FQACLRPLLD QDAEGSWNKS IEATAYGILI   480
LTEARRVCFF DRLSEPLNEA IRRGIAFADS MSGTEAQLNY IWIEKVSYAP ALLTKSYLLA   540
ARWAAKSPLG ASVGSSLWTP PREGLDKHVR LFHQAELFRS LPEWELRASM IEAALFTPLL   600
RAHRLDVFPR QDVGEDKYLD VVPFFWTAAN NRDRTYASTL FLYDMCFIAM LNFQLDEFME   660
ATAGILFRDH MDDLRQLIHD LLAEKTSPKS SGRSSQGTKD ADSGIEEDVS MSDSASDSQD   720
RSPEYDLVFS ALSTFTKHVL QHPSIQSASV WDRKLLAREM KAYLLAHIQQ AEDSTPLSEL   780
KDVPQKTDVT RVSTSTTTFF NWVRTTSADH ISCPYSFHFV ACHLGAALSP KGSNGDCYPS   840
AGEKFLAAAV CRHLATMCRM YNDLGSAERD SDEGNLNSLD FPEFADSAGN GGIEIQKAAL   900
LRLAEFERDS YLEAFRRLQD ESNRVHGPAG GDEARLSRRR MAILEFFAQQ VDLYGQVYVI   960
RDISARIPKN EVEKKRKLDD AFN                                           983
```

SEQ ID NO: 55

```
atggcttcta gtacacttat ccaaaacaga tcatgtggcg tcacatcatc tatgtcaagt     60
tttcaaatct tcagaggtca accactaaga tttcctggca ctagaacccc agctgcagtt   120
caatgcttga aaaagaggag atgccttagg ccaaccgaat ccgtactaga atcatctcct   180
ggctctggtt catatagaat agtaactggc ccttctggaa ttaaccctag ttctaacggg   240
cacttgcaag agggttcctt gactcacagg ttaccaatac caatggaaaa atctatcgat   300
aacttccaat ctactctata tgtgtcagat atttggtctg aaacactaca gagaactgaa   360
tgtttgctac aagtaactga aaacgtccag atgaatgagt ggattgagga aattagaatg   420
tacttagaa atatgacttt aggtgaaatt tccatgtccc cttacgacac tgcttgggtg   480
gctagagttc cagcgttgga cggttctcat gggcctcaat tccacagatc tttgcaatgg   540
attatcgaca accaattacc agatggggac tggggcgaac cttctctttt cttgggttac   600
gatagagttt gtaatacttt agcctgtgtg attgcgttga aacatgggg tgttggggca   660
caaaacgttg aaagaggaat tcagttccta caatctaaca tatacaagat ggaggaagat   720
gacgctaatc atatgccaat aggattcgaa atcgtattcc ctgctatgat ggaagatgcc   780
aaagcattag gtttggattt gccatacgat gctactattt tgcaacagat ttcagccgaa   840
agagagaaaa agatgaaaaa gatcccaatg gcaatggtgt acaaatccc aaccactta    900
cttcactcct tagaaggctt gcatagaaga gttgattgga ataagttgtt acaattacaa   960
tctgaaaatg gtagttttct ttattcacct gcttcaaccg catgcgcctt aatgtacact  1020
aaggacgtta aatgttttga ttacttaaac cagttgttga tcaagttcga ccacgcatgc  1080
ccaaatgtat atccagtcga tctattcgaa agattatgga tggttgacag attgcagaga  1140
ttagggatct ccagatactt tgaaagagag attagagatt gtttacaata gctctacaga  1200
tattggaaag attgtggaat cggatgggct tctaactctt ccgtacaaga tgttgatgat  1260
acagccatgc cgtttagact tttaaggact catggtttcg acgtaaagga agattgcttt  1320
agacagtttt tcaaggacgg agaattcttc tgcttcgcag ccaatcatc tcaagcagtt  1380
aacaggcagt ttaatcttt aagagccagt caaaacattgt ttccaggaga atcttttattg  1440
aaaaaggcta gaaccttctc tagaaacttc ttgagaacaa agcatgagaa caacgaatgt  1500
ttcgataaat ggatcattac taaagatttg gctggtgaag tcgagtataa cttgaccttc  1560
ccatggtatg cctctttgcc tagattgaa catagagcat acttagatca atatggaatc  1620
gatgatatct ggataggcaa atctttatac aaaatgcctg ctgttaccaa cgaagtttc  1680
ctaaagttgg caaaggcaga cttttaacatg tgtcaagctc tacacaaaaa ggaattggaa  1740
```

TABLE 10-continued

Sequences disclosed herein.

```
caagtgataa agtggaacgc gtcctgtcaa ttcagagatc ttgaattcgc cagacaaaaa  1800
tcagtagaat gctattttgc tggtgcagcc acaatgttcg aaccagaaat ggttcaagct  1860
agattagtct gggcaagatg ttgtgtattg acaactgtct tagacgatta ctttgaccac  1920
gggacacctg ttgaggaact tagagtgttt gttcaagctg tcagaacatg gaatccagag  1980
ttgatcaacg gtttgccaga gcaagctaaa atcttgttta tgggcttata caaaacagtt  2040
aacacaattg cagaggaagc attcatggca cagaaaagag acgtccatca tcatttgaaa  2100
cactattggg acaagttgat aacaagtgcc ctaaaggagg ccgaatgggc agagtcaggt  2160
tacgtcccaa catttgatga atacatggaa gtagctgaaa tttctgttgc tctagaacca  2220
attgtctgta gtaccttgtt cttttgcgggt catagactag atgaggatgt tctagatagt  2280
tacgattacc atctagttat gcatttggta acagagtcg gtagaatctt gaatgatata  2340
caaggcatga agagggaggc ttcacaaggt aagatctcat cagttcaaat ctacatggag  2400
gaacatccat ctgttccatc tgaggccatg gcgatcgctc atcttcaaga gttagttgat  2460
aattcaatgc agcaattgac atacgaagtt cttaggttca ctgcggttcc aaaaagttgt  2520
aagagaatcc acttgaatat ggctaaaatc atgcatgcct tctacaagga tactgatgga  2580
ttctcatccc ttactgcaat gacaggattc gtcaaaaagg ttcttttcga acctgtgcct  2640
gagtaa                                                              2646
```

SEQ ID NO: 56

```
MASSTLIQNR SCGVTSSMSS FQIFRGQPLR FPGTRTPAAV QCLKKRRCLR PTESVLESSP   60
GSGSYRIVTG PSGINPSSNG HLQEGSLTHR LPIPMEKSID NFQSTLYVSD IWSETLQRTE  120
CLLQVTENVQ MNEWIEEIRM YFRNMTLGEI SMSPYDTAWV ARVPALDGSH GPQFHRSLQW  180
IIDNQLPDGD WGEPSLFLGY DRVCNTLACV IALKTWGVGA QNVERGIQFL QSNIYKMEED  240
DANHMPIGFE IVFPAMMEDA KALGLDLPYD ATILQQISAE REKKMKKIPM AMVYKYPTTL  300
LHSLEGLHRE VDWNKLLQLQ SENGSFLYSP ASTACALMYT KDVKCFDYLN QLLIKFDHAC  360
PNVYPVDLFE RLWMVDRLQR LGISRYFERE IRDCLQYVYR YWKDCGIGWA SNSSVQDVDD  420
TAMAFRLLRT HGFDVKEDCF RQFFKDGEPF CFAGQSSQAV TGMFNLSRAS QTLFPGESLL  480
KKARTFSRNF LRTKHENNEC FDKWIITKDL AGEVEYNLTF PWYASLPRLE HRTYLDQYGI  540
DDIWIGKSLY KMPAVTNEVF LKLAKADFNM CQALHKKELE QVIKWNASCQ FRDLEFARQK  600
SVECYFAGAA TMFEPEMVQA RLVWARCCVL TTVLDDYFDH GTPVEELRVF VQAVRTWNPE  660
LINGLPEQAK ILFMGLYKTV NTIAEEEAFMA QKRDVHHHLK HYWDKLITSA LKEAEWAESG  720
YVPTFDEYME VAEISVALEP IVCSTLFFAG HRLDEDVLDS YDYHLVMHLV NRVGRILNDI  780
QGMKREASQG KISSVQIYME EHPSVPSEAM AIAHLQELVD NSMQQLTYEV LRFTAVPKSC  840
KRIHLNMAKI MHAFYKDTDG FSSLTAMTGF VKKVLFEPVP E                      881
```

SEQ ID NO: 57

```
atgcctggta aaattgaaaa tggtacccca aaggacctca agactggaaa tgattttgtt   60
tctgctgcta agagtttact agatcgagct ttcaaaagtc atcattccta ctacggatta  120
tgctcaactt catgtcaagt ttatgataca gcttgggttg cagatgattcc aaaaacaaga  180
gataatgtaa aacagtggtt gtttccagaa tgtttccatt acctcttaaa aacacaagcc  240
gcagatggct catgggggttc attgcctaca acacagacag cgggtatcct agatacagcc  300
tcagctgtgc tggcattatt gtgccacgca caagagcctt acaaatatt ggatgtatct  360
ccagatgaaa tggggttgag aatagaacac ggtgtcaca ccttgaaacg tcaattagca  420
gtttggaatg atgtggagga caccaaccat attggcgtcg agtttatcat accagcctta  480
cttttccatgc tagaaaagga attagatgtt ccatctttg aatttccatg taggtccatc  540
ttagagagaa tgcacgggga gaaattaggt catttcgacc tggaacaagt ttacggcaag  600
ccaagctcat tgttgcactc attggaagca tttctcggta agctagattt tgatcgacta  660
tcacatcacc tataccacgg cagtatgatg gcatctccat cttcaacggc tgcttatctt  720
attggggcta caaaatggga tgacgaagcc gaagattacc taagacatgt aatgcgtaat  780
ggtgcaggac atgggaatgg aggtatttct ggtacatttc caactactca tttcgaatgt  840
agctggatta tgcaacgtt gttaaaggtt ggctttactt tgaagcaaat tgacggcagt  900
ggcttaagag gtttatcaac catcttactt gaggcgcttc gtgatgagaa tggtgtcata  960
ggctttgccc ctagaacagc agatgtagat gacacagcca agctctatt ggccttgtca 1020
ttggtaaacc agccagtgtc acctgatatc atgattaagg tctttgaggg caaagaccat 1080
tttaccactt ttggttcaga aagagatcca tcattgactt ccaacctgca cgtcctttta 1140
tctttactta aacaatctaa cttgtctcaa taccatcctc aaatcctcaa acaacatta  1200
ttcacttgta gatggtggtg gggttccgat cattgtgtca aagacaaatg gaatttgagt 1260
cacctatatc caactatgtt gttggttgaa gccttcactg aagtgctcca tctcattgac 1320
ggtggtgaat tgtctagtct gtttgatgaa tcctttaagt gtaagattgg tcttagcatc 1380
tttcaagcgg tacttagaat aatcctcacc caagacacg acggtcttg gagaggatac 1440
agagaacaga cgtgttacgc aatattggct ttagttcaag cgagacatgt atgcttttc  1500
actcacatgt tgacagact gcaatcatgt gttgatcgag gtttctcatg gttgaaatct 1560
tgctcttttc attctcaaga cctgacttgg acctctaaaa cagcttatga agtgggtttc 1620
gtagctgaag catataaact agctgcttta caatctgctc ccctggaggt tcctgctgcc 1680
accattggac attctgtcac gtctgccgtt ccatcaagtg atcttgaaaa atacatgaga 1740
ttggtgagaa aaactgcgtt attctctcca ctgatgagt ggggtctaat ggcttctatc 1800
atcgaatctt cattttcgt accattactg caggcacaaa gagttgaaat atcccctaga 1860
gataatatca aggtggacga agataagtac ttgtctatta tcccattcac atgggtcgga 1920
tgcaataata ggtctagaac tttcgcaagt aacagatggc tatacgatat gatgtacctt 1980
tcattactcg gctatcaaac cgacgagtac atggaagctg tagctgggcc agtgtttggg 2040
gatgtttcct tgttacatca aacaattgat aaggtgattg ataatacaat gggtaacctt 2100
gcgagagcca atggaacagt acacgaggt aatgacatc agcacgaatc tcctaatata 2160
ggtcaagtcg aggacacctt gactcgtttc acaaattcag tcttgaatca caaagacgtc 2220
cttaactcta gctcatctga tcaagatact ttgagaagag agtttagaac attcatgcac 2280
gctcatataa cacaaatcga agataactca cgattcagta agcaagcctc atccgatgcg 2340
ttttcctctc ctgaacaatc ttactttcaa tgggtgaact caactggtgg ctcacatgtc 2400
gcttgcgcct attcatttgc cttctctaat tgcctcatgt ctgcaaattt gttgcagggt 2460
```

TABLE 10-continued

Sequences disclosed herein.

```
aaagacgcat ttccaagcgg aacgcaaaag tacttaatct cctctgttat gagacatgcc    2520
acaaacatgt gtagaatgta taacgacttt ggctctattg ccagagacaa cgctgagaga    2580
aatgttaata gtattcattt tcctgagttt actctctgta acggaacttc tcaaaaccta    2640
gatgaaagga aggaaagact tctgaaaatc gcaacttacg aacaagggta tttggataga    2700
gcactagagg ccttggaaag acagagtaga gatgatgccg gagacagagc tggatctaaa    2760
gatatgagaa agttgaaaat cgttaagtta ttctgtgatg ttacggactt atacgatcag    2820
ctctacgtta tcaaagattt gtcatcctct atgaagtaa                           2859
```

SEQ ID NO: 58

```
MPGKIENGTP KDLKTGNDFV SAAKSLLDRA FKSHHSYYGL CSTSCQVYDT AWVAMIPKTR     60
DNVKQWLFPE CFHYLLKTQA ADGSWGSLPT TQTAGILDTA SAVLALLCHA QEPLQILDVS    120
PDEMGLRIEH GVTSLKRQLA VWNDVEDTNH IGVEFIIPAL LSMLEKELDV PSFEFPCRSI    180
LERMHGEKLG HFDLEQVYGK PSSLLHSLEA FLGKLDFDRL SHHLYHGSMM ASPSSTAAYL    240
IGATKWDDEA EDYLRHVMRN GAGHGNGGIS GTFPTTHFEC SWIIATLLKV GFTLKQIDGD    300
GLRGLSTILL EALRDENGVI GFAPRTADVD DTAKALLALS LVNQPVSPDI MIKVFEGKDH    360
FTTFGSERDP SLTSNLHVLL SLLKQSNLSQ YHPQILKTTL FTCRWWWGSD HCVKDKWNLS    420
HLYPTMLLVE AFTEVLHLID GGELSSLFDE SFKCKIGLSI FQAVLRIILT QDNDGSWRGY    480
REQTCYAILA LVQARHVCFF THMVDRLQSC VDRGFSWLKS CSFHSQDLTW TSKTAYEVGF    540
VAEAYKLAAL QSASLEVPAA TIGHSVTSAV PSSDLEKYMR LVRKTALFSP LDEWGLMASI    600
IESSFFVPLL QAQRVEIYPR DNIKVDEDKY LSIIPFTWVG CNNRSRTFAS NRWLYDMMYL    660
SLLGYQTDEY MEAVAGPVFG DVSLLHQTID KVIDNTMGNL ARANGTVHSG NGHQHESPNI    720
GQVEDTLTRF TNSVLNHKDV LNSSSSDQDT LRREFRTFMH AHITQIEDNS RPSKQASSDA    780
FSSPEQSYFQ WVNSTGGSHV ACAYSFAFSN CLMSANLLQG KDAFPSGTQK YLISSVMRHA    840
TNMCRMYNDF GSIARDNAER NVNSIHFPEF TLCNGTSQNL DERKERLLKI ATYEQGYLDR    900
ALEALERQSR DDAGDRAGSK DMRKLKIVKL FCDVTDLYDQ LYVIKDLSSS MK            952
```

SEQ ID NO: 59

```
atggatgctg tgacgggttt gttaactgtc ccagcaaccg ctataactat tggtggaact     60
gctgtagcat tggcggtagc gctaatcttt tggtacctga atcctacac atcagctaga    120
agatcccaat caaatcatct tccaagagtg cctgaagttc caggtgttcc attgttagga    180
aatctgttac aattgaagga gaaaaagcca tacatgactt ttacgagatg ggcagcgaca    240
tatgaccta tctatagtat caaaactggg gctacaagta tggttgtggt atcatctaat    300
gagatagcca aggaggcatt ggtgaccaga ttccaatcca tatctacaag gaacttatct    360
aaagccctga aagtacttac agcagataag acaatggtca caatgtcaga ttatgatgat    420
tatcataaaa cagttaagag acacatactg accgccgtct gggtcctaa tgcacagaaa    480
aagcatgaa ttcacagaga tatcatgatg gataacatat ctactcaact tcatgaattc    540
gtgaaaaaca acccagaaca ggaagaggta gaccttagaa aaatctttca atctgagtta    600
ttcggcttag ctatgagaca agccttagga aaggatgtta cgttgaagac                660
ctgaaaatca ctatgaatag agacgaaatc tttcaagtcc ttgttgttga tccaatgatg    720
ggagcaatcg atgttgattg gagagacttc ttccatacc taaagtgggt cccaaacaaa    780
aagttcgaaa atactattca acaaatgtac atcagaagag aagctgttat gaaatcttta    840
atcaaagagc acaaaaagag aatagcgtca ggcgaattac gaaatagtta tatcgattac    900
cttttatctg aagctcaaac tttaaccgat cagcaactat tgatgtcctt gtgggaacca    960
atcattgaat cttcagatac aacaatggtc acaacagaat gggcaatgta cgaattagct   1020
aaaaacccta aattgcaaga taggttgtac agagacatta gtccgtctg tggatctgaa   1080
aagataaccg aagagcatct atcacagctg ccttacatta cagctatttt ccacgaaaca   1140
ctgagaagac actcaccagt tcctatcatt cctctaagac atgtacatga agataccgtt   1200
ctaggcggct accatgttcc tgctggcaca gaacttgccg ttaacatcta cggttgcaac   1260
atggacaaaa acgtttggga aaatccagag gaatggaacc cagaaagatt catgaaagag   1320
aatgagacaa ttgattttca aaagacgatg gccttcggtg gtgtgaagag agtttgtgct   1380
ggttccttgc aagcccttt aactgcatct attggggattg ggagaatggt tcaagagttc   1440
gaatggaaac tgaaggatat gactcaagag gaagtgaaca cgataggcct aactacacaa   1500
atgttaagac cattgagagc tattatcaaa cctaggatct aa                      1542
```

SEQ ID NO: 60

```
MDAVTGLLTV PATAITIGGT AVALAVALIF WYLKSYTSAR RSQSNHLPRV PEVPGVPLLG     60
NLLQLKEKKP YMTFTRWAAT YGPIYSIKTG ATSMVVVSSN EIAKEALVTR FQSISTRNLS    120
KALKVLTADK TMVAMSDYDD YHKTVKRHIL TAVLGPNAQK KHRIHRDIMM DNISTQLHEF    180
VKNNPEQEEV DLRKIFQSEL FGLAMRQALG KDVESLYVED LKITMNRDEI FQVLVVDPMM    240
GAIDVDWRDF FPYLKWVPNK KFENTIQQMY IRREAVMKSL IKEHKKRIAS GEKLNSYIDY    300
LLSEAQTLTD QQLMSLWEP IIESSDTTMV TTEWAMYELA KNPKLQDRLY RDIKSVCGSE    360
KITEEHLSQL PYITAIFHET LRRHSPVPII PLRRHVEDTV LGGYHVPAGT ELAVNIYGCN    420
MDKNVWENPE EWNPERFMKE NETIDFQKTM AFGGGKRVCA GSLQALLTAS IGIGRMVQEF    480
EWKLKDMTQE EVNTIGLTTQ MLRPLRAIIK PRI                                 513
```

SEQ ID NO: 61

```
aagcttacta gtaaaatgga cggtgtcatc gatatgcaaa ccattccatt gagaaccgct     60
attgctattg gtggtactgc tgttgctttg gttgttgcat tatactttg gttcttgaga    120
tcctacgctt ccccatctca tcattctaat catttgccta cagtacctga agttccaggt    180
gttccagttt tgggtaattt gttgcaattg aaagaaaaa agccttacat gaccttcacc    240
aagtgggctg aaatgtatgg tccaatctac tctattagaa ctggtgctac ttccatggtt    300
gttgtctctt ctaacgaaat cgccaaagaa gttgttgtta ccagattccc atctatctct    360
accagaaaat tgtcttacgc cttgaaggtt tgaccgaag ataagtctat ggttgccatg    420
tctgattatc acgattacca taagaccgtc aagagacata ttttgactgc tgttttgggt    480
```

TABLE 10-continued

Sequences disclosed herein.

| | | | | | | |
|---|---|---|---|---|---|---|
| ccaaacgccc | aaaaaaagtt | tagagcacat | agagacacca | tgatggaaaa | cgtttccaat | 540 |
| gaattgcatg | ccttcttcga | aaagaaccca | aatcaagaag | tcaacttgag | aaagatcttc | 600 |
| caatcccaat | tattcggttt | ggctatgaag | caagccttgg | gtaaagatgt | tgaatccatc | 660 |
| tacgttaagg | atttggaaac | caccatgaag | agagaagaaa | tcttcgaagt | tttggttgtc | 720 |
| gatccaatga | tgggtgctat | tgaagttgat | tggagagact | tttccccata | cttgaaatgg | 780 |
| gttccaaaca | agtccttcga | aaacatcatc | catagaatgt | acactagaag | agaagctgtt | 840 |
| atgaaggcct | tgatccaaga | acacaagaaa | agaattgcct | ccggtgaaaa | cttgaactcc | 900 |
| tacattgatt | acttgttgtc | tgaagcccaa | accttgaccg | ataagcaatt | attgatgtct | 960 |
| ttgtgggaac | ctattatcga | atccttctgat | accactatgg | ttactactga | atgggctatg | 1020 |
| tacgaattgg | ctaagaatcc | aaacatgcaa | gacagattat | acgaagaaat | ccaatccgtt | 1080 |
| tgcggttccg | aaaagattac | tgaagaaaac | ttgtcccaat | tgccatactt | gtacgctgtt | 1140 |
| ttccaagaaa | ctttgagaaa | gcactgtcca | gttcctatta | tgccattgag | atatgttcac | 1200 |
| gaaaacaccg | ttttgggtgg | ttatcatgtt | ccagctggta | ctgaagttgc | tattaacatc | 1260 |
| tacggttgca | acatggataa | gaaggtctgg | gaaaatccag | aagaatggaa | tccagaaaga | 1320 |
| ttcttgtccg | aaaaagaatc | catggacttg | tacaaaacta | tggcttttgg | tggtggtaaa | 1380 |
| agagtttgcg | ctggttcttt | acaagccatg | gttatttctt | gcattggtat | cggtagattg | 1440 |
| gtccaagatt | ttgaatggaa | gttgaaggat | gatgccgaag | aagatgttaa | cactttgggt | 1500 |
| ttgactaccc | aaaagttgca | tccattattg | gccttgatta | acccaagaaa | gtaactcgag | 1560 |
| ccgcgg | | | | | | 1566 |

SEQ ID NO: 62

| | | | | | | |
|---|---|---|---|---|---|---|
| MDGVIDMQTI | PLRTAIAIGG | TAVALVVALY | FWFLRSYASP | SHHSNHLPPV | PEVPGVPVLG | 60 |
| NLLQLKEKKP | YMTFTKWAEM | YGPIYSIRTG | ATSMVVVSSN | EIAKEVVVTR | FPSISTRKLS | 120 |
| YALKVLTEDK | SMVAMSDYHD | YHKTVKRHIL | TAVLGPNAQK | KFRAHRDTMM | ENVSNELHAF | 180 |
| FEKNPNQEVN | LRKIFQSQLF | GLAMKQALGK | DVESIYVKDL | ETTMKREEIF | EVLVVDPMMG | 240 |
| AIEVDWRDFF | PYLKWVPNKS | FENIIHRMYT | RREAVMKALI | QEHKKRIASG | ENLNSYIDYL | 300 |
| LSEAQTLTDK | QLLMSLWEPI | IESSDTTMVT | TEWAMYELAK | NPNMQDRLYE | EIQSVCGSEK | 360 |
| ITEENLSQLP | YLYAVFQETL | RKHCPVPIMP | LRYVHENTVL | GGYHVPAGTE | VAINIYGCNM | 420 |
| DKKVWENPEE | WNPERFLSEK | ESMDLYKTMA | FGGGKRVCAG | SLQAMVISCI | GIGRLVQDFE | 480 |
| WKLKDDAEED | VNTLGLTTQK | LHPLLALINP | RK | | | 512 |

SEQ ID NO: 63

| | | | | | | |
|---|---|---|---|---|---|---|
| atggccaccc | tccttgagca | tttccaagct | atgccctttg | ccatccctat | tgcactggct | 60 |
| gctctgtctt | ggctgttcct | cttttacatc | aaagtttcat | tcttcttccaa | caagagtgct | 120 |
| caggctaagc | tccctcctgt | gccagtggtt | cctgggctgc | cggtgattgg | gaatttactg | 180 |
| caactcaagg | agaagaaacc | ctaccagact | tttacaaggt | gggctgagga | gtatggacca | 240 |
| atctattcta | tcaggactgg | tgcttccacc | atggtcgttc | tcaataccac | ccaagttgca | 300 |
| aaagaggcca | tggtgaccag | atatttatcc | atctcaacca | gaaagctacg | aaacgcacta | 360 |
| aagattctta | ctgctgataa | atgtatggtt | gcaataagtg | actacaacga | ttttcacaag | 420 |
| atgataaagc | gatacatact | ctcaaatgtt | cttggaccta | gtgctcagaa | gcgtcaccgg | 480 |
| agcaacagag | ataccttgag | agctaatgtc | tgcagccgat | gcattctcaa | agtaaagaac | 540 |
| tctcctcgag | aagctgtgaa | tttcagaaga | gttttttgagt | gggaactctt | tggaattgca | 600 |
| ttgaagcaag | cctttggaaa | ggacatagaa | aagcccattt | atgtggagga | acttggcact | 660 |
| acactgtcaa | gagatgagat | cttttaaggtt | ctagtgcttg | acataatgga | gggtgcaatt | 720 |
| gaggttgatt | ggagagattt | cttcccttac | ctgagatgga | ttccgaatac | gcgcatggaa | 780 |
| acaaaaattc | agcgactcta | tttccgcagg | aaagcagtga | ttgccccct | gatcaacgag | 840 |
| cagaagaagc | gaattgcttc | aggagaggaa | atcaactgtt | atatcgactt | cttgcttaag | 900 |
| gaagggaaga | cactgacaat | ggaccaaata | agtatgttgc | tttgggagac | ggttattgaa | 960 |
| acagcagata | ctacaatggt | aacgacgaaa | tgggctatgt | atgaagttgc | taaagactca | 1020 |
| aagcgtcagg | atcgtctcta | tcaggaaatc | caaaaggttt | gtgggatcgga | gatggttaca | 1080 |
| gaggaatact | tgtcccaact | gccgtacctg | aatgcagttt | tccatgaaac | gctaaggaag | 1140 |
| cacagtccgg | ctgcgttagt | tccttttaaga | tatgcacatg | aagatacccca | actaggaggt | 1200 |
| tactacattc | cagctggaac | tgagattgct | ataaacatat | acgggtgtaa | catggacaag | 1260 |
| catcaatggg | aaagccctga | ggaatggaaa | ccggagagat | ttttgaccc | gaaatttgat | 1320 |
| cctatggatt | tgtacaagac | catggctttt | ggggctggaa | agagggtatg | tgctggttct | 1380 |
| cttcaggcaa | tgttaatagc | gtgcccgacg | attggtaggc | tggtgcagga | gtttgagtgg | 1440 |
| aagctgagag | atggagaaga | agaaaatgta | gatactgttg | ggctcaccac | tcacaaacgc | 1500 |
| tatccaatgc | atgcaatcct | gaagccaaga | agtta | | | 1535 |

SEQ ID NO: 64

| | | | | | | |
|---|---|---|---|---|---|---|
| atggctacct | tgttggaaca | ttttcaagct | atgccattcg | ctattccaat | tgctttggct | 60 |
| gctttgtctt | ggttgttttt | gttctacatc | aaggtttctt | tcttctccaa | caatccgtct | 120 |
| caagctaaat | tgccaccagt | tccagttgtt | ccaggtttgc | cagttattgg | taatttgttg | 180 |
| caattgaaag | aaaagaagcc | ataccaaacc | ttcactagat | gggctgaaga | atatggtcca | 240 |
| atctactcta | ttagaactgg | tgcttctact | atggttgtct | tgaacactac | tcaagttgcc | 300 |
| aaagaagcta | tggttaccag | atacttgtct | atctctcaca | gaaagtttgt | caacgccttg | 360 |
| aaaattttga | ccgctgataa | atgcatggtt | gccatttctg | attacaacga | ttttccacaag | 420 |
| atgatcaaga | gatatatctt | gtctaacgtt | ttggtccat | ctgcccaaaa | aagacataga | 480 |
| tctaacagag | ataccttgag | agccaacgtt | tgttctagat | gcattcccca | agttaagaac | 540 |
| tctccaagag | aagctgtcaa | ctttagaaga | gttttcgaat | gggaaattatt | cggtatcgct | 600 |
| ttgaaacaag | ccttcggtaa | ggatattgaa | aagccaatct | acgtcgaaga | attgggtact | 660 |
| actttgtcca | gagatgaaat | cttcaaggtt | ttggtcttgg | acattatgga | aggtgccatt | 720 |
| gaagttgatt | ggagagattt | tttcccatac | ttgcgttgga | ttccaaacac | cagaatggaa | 780 |
| actaagatcc | aaagattata | ctttagaaga | aaggccgtta | tgaccgcctt | gattaacgaa | 840 |
| caaaagaaaa | gaattgcctc | cggtgaagaa | tcaactgct | catcgatttt | cttgttgaaa | 900 |

TABLE 10-continued

Sequences disclosed herein.

```
gaaggtaaga ccttgaccat ggaccaaatc tctatgttgt tgtgggaaac cgttattgaa    960
actgctgata ccacaatggt tactactgaa tgggctatgt acgaagttgc taaggattct   1020
aaaagacaag acagattata ccaagaaatc caaaaggtct gcggttctga aatggttaca   1080
gaagaatact tgtcccaatt gccatacttg aatgctgttt tccacgaaac tttgagaaaa   1140
cattctccag ctgctttggt tccattgaga tatgctcatg aagatactca attgggtggt   1200
tattacattc cagccggtac tgaaattgcc attaacatct acggttgcaa catggacaaa   1260
caccaatggg aatctccaga agaatggaag ccagaaagat ttttggatcc taagtttgac   1320
ccaatggact tgtacaaaac tatggctttt ggtgctggta aaagagtttg cgctggttct   1380
ttacaagcta tgttgattgc ttgtccaacc atcggtagat tggttcaaga atttgaatgg   1440
aagttgagag atggtgaaga agaaaacgtt gatactgttg gtttgaccac cataagagaa   1500
tatccaatgc atgctatttt gaagccaaga tcttaa                             1536
```

SEQ ID NO: 65

```
aagcttacta gtaaaatggc ctccatcacc catttcttac aagattttca agctactcca     60
ttcgctactg ctttttgctgt tggtggtgtt tcttttgttga tattcttctt cttcatccgt   120
ggtttccact ctactaagaa aaacgaatat tacaagttgc caccagttcc agttgttcca    180
ggtttgccag ttgttggtaa tttgttgcaa ttgaaagaaa agaagccata caagactttc    240
ttgagatggg ctgaaattca tggtccaatc tactctatta gaactggtgc ttctaccatg    300
gttgttgtta actctactca tgttgccaaa gaagctatgg ttaccagatt ctcttcaatc    360
tctaccagaa agttgtccaa ggctttggaa ttattgacct ccaacaaatc tatggttgcc    420
acctctgatt acaacgaatt tcacaagatg gtcaagaagt acatcttggc cgaattattg    480
ggtgctaatg ctcaaaagag acacagaatt catagagaca ccttgatcga aaacgtcttg    540
aacaaattgc atgcccatac caagaattct ccattgcaag ctgttaactt cagaaagatc    600
ttcgaatctg aattattcgg tttggctatg aagcaagcct tgggttatga tgttgattcc    660
ttgttcgttg aagaattggg tactaccttg tccagaagaa aaatctacaa cgttttggtc    720
agtgacatgt tgaagggtgc tattgaagtt gattggagag acttttttccc atacttgaaa    780
tggatcccaa acaagtcctt cgaaatgaag attcaaagat tggcctctag aagacaagcc    840
gttatgaact ctattgtcaa agaacaaaag aagtccattg cctctggtaa gggtgaaaac    900
tgttacttga attacttgtt gtccgaagct aagactttga ccgaaaagca aatttccatt    960
ttggcctggg aaaccattat tgaaactgct gatacaactg ttgttaccac tgaatgggct   1020
atgtacgaat tggctaaaaa cccaaagcaa caagacagat tatacaacga aatccaaaac   1080
gtctgcggta ctgataagat taccgaagaa catttgtcca agttgcctta cttgtctgct   1140
gttttttcacg aaaccttgag aaagtattct ccatctccat tggttccatt gagatacgct   1200
catgaagata ctcaattggg tggttattat gttccagccg gtactgaaat tgctgttaat   1260
atctacggtt gcaacatgga caagaatcaa tgggaaactc cagaagaatg gaagccagaa   1320
agattttttgg acgaaaagta cgatccaatg gacatgtaca agactatgtc ttttggttcc   1380
ggtaaaagag tttgcgctgg ttctttacaa gctagtttga ttgcttgtac ctccatcggt   1440
agattggttc aagaatttga atggagattg aaagacggtg aagttgaaaa cgttgatacc   1500
ttgggtttga ctacccataa gttgtatcca atgcaagcta tcttgcaacc tagaaactga   1560
ctcgagccgc gg                                                       1572
```

SEQ ID NO: 66

```
MASITHFLQD FQATPFATAF AVGGVSLLIF FFFIRGFHST KKNEYYKLPP VPVVPGLPVV     60
GNLLQLKEKK PYKTFLRWAE IHGPIYSIRT GASTMVVVNS THVAKEAMVT RFSSISTRKL    120
SKALELLTSN KSMVATSDYN EFHKMVKKYI LAELLGANAQ KRHRIHRDTL IENVLNKLHA    180
HTKNSPLQAV NFRKIFESEL FGLAMKQALG YDVDSLFVEE LGTTLSREEI YNVLVSDMLK    240
GAIEVDWRDF FPYLKWIPNK SFEMKIQRLA SRRQAVMNSI VKEQKKSIAS GKGENCYLNY    300
LLSEAKTLTE KQISILAWET IIETADTTVV TTEWAMYELA KNPKQQDRLY NEIQNVCGTD    360
KITEEHLSKL PYLSAVFHET LRKYSPSPLV PLRYAHEDTQ LGGYYVPAGT EIAVNIYGCN    420
MDKNQWETPE EWKPERFLDE KYDPMDMYKT MSFGSGKRVC AGSLQASLIA CTSIGRLVQE    480
FEWRLKDGEV ENVDTLGLTT HKLYPMQAIL QPRN                                514
```

SEQ ID NO: 67

```
atgatttcct tgttgttggg ttttgttgtc tcctccttct tgtttatctt cttcttgaaa     60
aaattgttgt tcttcttcag tcgtcacaaa atgtccgaag tttctagatt gccatctgtt    120
ccagttccag gttttccatt gattggtaac ttgttgcaat tgaaagaaaa gaagccacac    180
aagactttca ccaagtggtc tgaattatat ggtccaatct actctatcaa gatgggttcc    240
tcttctttga tcgtcttgaa ctctattgaa accgccaaag aagctatggt cagtagattc    300
tcttcaatct ctaccagaaa gttgtctaac gctttgactg ttttgacctg caacaaatct    360
atggttgcta cctctgatta cgatgacttt cataagttcg tcaagagatg cttgttgaac    420
ggtttgttgg gtgctaatgc tcaagaaaga aaaagacatt acagagatgc cttgatcgaa    480
aacgttacct ctaaattgca tgcccatacc agaaatcact cacaagactc agttaacttc    540
agagccattt tcgaacacga attattcggt gttgctttga acaagcctt cggtaaagat    600
gtcgaatcca tctatgtaaa agaatttggg tgtcaccttg tccagaaatga aattttcaag    660
gttttggtcc acgacatgat ggaaggtgct attgatgttg attggagaga tttcttccca    720
tacttgaaat ggatcccaaa caactctttc gaagccagaa ttcaacaaaa gcacaagaga    780
agattggcta ttatgaacgc cttgatccaa acagattga atcaaaacga ttccgaatcc    840
gatgatgact gctactgaa tttctgatg tctgaagcta gaccttgac catggaacaa    900
attgctattt tggtttggga accatatc gaaactgctg ataccactt ggttactact    960
gaatgggcta tgtacgaatt ggccaaacat caatctgctg aagatagatt attcaaagaa   1020
atccacccg tctgcggtgg tgaaagatc aaagaagaac aattgccaag attgccttac   1080
gtcaatggtg ttttttcacga aaccttgaga aagtattctc cagctccatt ggttccaatt   1140
agatacgctc atgaagatac ccaattggtt ggttatcata ttccagccgg ttctgaaatt   1200
gccattaaca tctacggttg caacatggat aagaagagat gggaaagacc tgaagaatgg   1260
tggccagaaa gattttttgga agatagatac gaatcctccg acttgcataa gactatggct   1320
```

TABLE 10-continued

Sequences disclosed herein.

| | | | | | |
|---|---|---|---|---|---|
| tttggtgctg | gtaaaagagt | ttgtgctggt | gctttacaag | ctagtttgat | ggctggtatt | 1380 |
| gctatcggta | gattggttca | agaattcgaa | tggaagttga | gagatggtga | agaagaaaac | 1440 |
| gttgatactt | acggtttgac | ctcccaaaag | ttgtatccat | tgatggccat | tatcaaccca | 1500 |
| agaagatctt | aa | | | | | 1512 |

SEQ ID NO: 68

| | | | | | |
|---|---|---|---|---|---|
| MASMISLLLG | FVVSSFLFIF | FLKKLLFFFS | RHKMSEVSRL | PSVPVPGFPL | IGNLLQLKEK | 60 |
| KPHKTFTKWS | ELYGPIYSIK | MGSSSLIVLN | SIETAKEAMV | SRFSSISTRK | LSNALTVLTC | 120 |
| NKSMVATSDY | DDFHKFVKRC | LLNGLLGANA | QERKRHYRDA | LIENVTSKLH | AHTRNHPQEP | 180 |
| VNFRAIFEHE | LFGVALKQAF | GKDVESIYVK | ELGVTLSRDE | IFKVLVHDMM | EGAIDVDWRD | 240 |
| FFPYLKWIPN | NSFEARIQQK | HKRRLAVMNA | LIQDRLNQND | SESDDDCYLN | FLMSEAKTLT | 300 |
| MEQIAILVWE | TIIETADTTL | VTTEWAMYEL | AKHQSVQDRL | FKEIQSVCGG | EKIKEEQLPR | 360 |
| LPYVNGVFHE | TLRKYSPAPL | VPIRYAHEDT | QIGGYHIPAG | SEIAINIYGC | NMDKKRWERP | 420 |
| EEWWPERFLE | DRYESSDLHK | TMAFGAGKRV | CAGALQASLM | AGIAIGRLVQ | EFEWKLRDGE | 480 |
| EENVDTYGLT | SQKLYPLMAI | INPRRS | | | | 506 |

SEQ ID NO: 69

| | | | | | |
|---|---|---|---|---|---|
| aagcttacta | gtaaaatgga | catgatgggt | attgaagctg | ttccatttgc | tactgctgtt | 60 |
| gttttgggtg | gtatttcctt | ggttgttttg | atcttcatca | gaagattcgt | ttccaacaga | 120 |
| aagagatccg | ttgaaggttt | gccaccagtt | ccagatattc | caggtttacc | attgattggt | 180 |
| aacttgttgc | aattgaaaga | aaagaagcca | cataagacct | ttgctagatg | ggctgaaact | 240 |
| tacggtccaa | tttctctat | tagaactggt | gcttctacca | tgatcgtctt | gaattcttct | 300 |
| gaagttgcca | agaagctat | ggtcactaga | ttctcttcaa | tctctaccag | aaagttgtcc | 360 |
| aacgccttga | agattttgac | cttcgataag | tgtatggttg | ccacctctga | ttacaacgat | 420 |
| tttcacaaaa | tggtcaaggg | tttcatcttg | agaaacgttt | taggtgctcc | agcccaaaaa | 480 |
| agacatagat | gtcatagaga | taccttgatc | gaaaacatct | ctaagtactt | gcatgcccat | 540 |
| gttaagactt | ctccattgga | accagttgtc | ttgaagaaga | ttttcgaatc | cgaaattttc | 600 |
| ggtttggctt | tgaaacaagc | cttgggtaag | gatatcgaat | ccatctatgt | tgaagaattg | 660 |
| ggtactacct | tgtccagaga | agaaattttt | gccgttttgg | ttgttgatcc | aatggctggt | 720 |
| gctattgaag | ttgattggag | agattttttc | ccatacttgt | cctggattcc | aaacaagtct | 780 |
| atggaaatga | agatccaaag | aatggatttt | agaagaggtg | ctttgatgaa | ggccttgatt | 840 |
| ggtgaacaaa | agaaaagaat | cggttccggt | gaagaaaaga | actcctacat | tgatttcttg | 900 |
| ttgtctgaag | ctaccacttt | gaccgaaaag | caaattgcta | tgttgatctg | ggaaaccatc | 960 |
| atcgaaattt | ccgatacaac | tttggttacc | tctgaatggg | ctatgtacga | attggctaaa | 1020 |
| gacccaaata | gacaagaaat | cttgtacaga | gaaatccaca | aggtttgcgg | ttctaacaag | 1080 |
| ttgactgaag | aaaacttgtc | caagttgcca | tacttgaact | ctgttttcca | cgaaaccttg | 1140 |
| agaaagtatt | ctccagctcc | aatggttcca | gttagatatg | ctcatgaaga | tactcaattg | 1200 |
| ggtggttacc | atattccagc | tggttctcaa | attgccatta | acatctacgg | ttgcaacatg | 1260 |
| aacaaaaagc | aatgggaaaa | tcctgaagaa | tggaagccag | aaagattctt | ggacgaaaag | 1320 |
| tatgacttga | tggacttgca | taagactatg | gcttttggtg | gtggtaaaag | agtttgtgct | 1380 |
| ggtgctttac | aagcaatgtt | gattgcttgc | acttccatcg | gtagattcgt | tcaagaattt | 1440 |
| gaatggaagt | tgatgggtgg | tgaagaagaa | aacgttgata | ctgttgcttt | gacctcccaa | 1500 |
| aaattgcatc | caatgcaagc | cattattaag | gccagagaat | gactcgagcc | gcgg | 1554 |

SEQ ID NO: 70

| | | | | | |
|---|---|---|---|---|---|
| MDMMGIEAVP | FATAVVLGGI | SLVVLIFIRR | FVSNRKRSVE | GLPPVPDIPG | LPLIGNLLQL | 60 |
| KEKKPHKTFA | RWAETYGPIF | SIRTGASTMI | VLNSSEVAKE | AMVTRFSSIS | TRKLSNALKI | 120 |
| LTFDKCMVAT | SDYNDFHKMV | KGFILRNVLG | APAQKRHRCH | RDTLIENISK | YLHAHVKTSP | 180 |
| LEPVVLKKIF | ESEIFGLALK | QALGKDIESI | YVEELGTTLS | REEIFAVLVV | DPMAGAIEVD | 240 |
| WRDFFPYLSW | IPNKSMEMKI | QRMDFRRGAL | MKALIGEQKK | RIGSGEEKNS | YIDFLLSEAT | 300 |
| TLTEKQIAML | IWETIIEISD | TTLVTSEWAM | YELAKDPNRQ | EILYREIHKV | CGSNKLTEEN | 360 |
| LSKLPYLNSV | FHETLRKYSP | APMVPVRYAH | EDTQLGGYHI | PAGSQIAINI | YGCNMNKKQW | 420 |
| ENPEEWKPER | FLDEKYDLMD | LHKTMAFGGG | KRVCAGALQA | MLIACTSIGR | FVQEFEWKLM | 480 |
| GGEEENVDTV | ALTSQKLHPM | QAIIKARE | | | | 508 |

SEQ ID NO: 71

| | | | | | |
|---|---|---|---|---|---|
| aagcttaaaa | tgagtaagtc | taatagtatg | aattctacat | cacacgaaac | ccttttttcaa | 60 |
| caattggtct | tgggtttgga | ccgtatgcca | ttgatggatg | ttcactggtt | gatctacgtt | 120 |
| gctttcggcg | catggttatg | ttcttatgtg | atacatgttt | tatcatcttc | ctctacagta | 180 |
| aaagtgccag | ttgttggata | caggtctgta | ttcgaaccta | catggttgct | tagacttaga | 240 |
| ttcgtctggg | aaggtggctc | tatcataggt | caagggtaca | ataagtttaa | agactctatt | 300 |
| ttccaagtta | ggaaattggg | aactgatatt | gtcattatac | cacctaacta | tattgatgaa | 360 |
| gtgagaaaat | tgtcacagga | caagactaga | tcagttgaac | ctttcattaa | tgattttgca | 420 |
| ggtcaataca | caagaggcat | ggttttcttg | caatctgact | acaaaaccg | tgttatacaa | 480 |
| caaagactaa | ctccaaaatt | ggtttccttg | accaaggtca | tgaaggaaga | gttggattat | 540 |
| gctttaacaa | aagagatgcc | tgatatgaaa | aatgacgaat | gggtagaagt | agatatcagt | 600 |
| agtataatgg | tgaagttgat | ttccaggatc | tccgccagag | tctttctagg | gcctgaacac | 660 |
| tgtcgtaacc | aggaatggtt | gactactaca | gcagaatatt | cagaatcact | tttcattaca | 720 |
| gggtttatct | taagagttgt | acctcatatc | ttaagaccat | tcatcgcccc | tctattacct | 780 |
| tcatacagga | ctctacttag | aaacgtttca | agtggtagaa | gagtcatcgg | tgacatcata | 840 |
| agatctcagc | aaggggatgg | taacgaagat | atacttcct | ggatgagaga | tgctgccaca | 900 |
| ggagaggaaa | agcaaatcga | taacattgct | cagagaatgt | taattctttc | tttagcatca | 960 |
| atccacacta | ctgcgatgac | catgacacat | gccatgtacg | atctatgtgc | ttgccctgag | 1020 |
| tacattgaac | cattaagaga | tgaagttaaa | tctgttgttg | gggcttctgg | ctgggacaag | 1080 |

TABLE 10-continued

Sequences disclosed herein.

| | | | | | |
|---|---|---|---|---|---|
| acagcgttaa | acagatttca | taagttggac | tccttcctaa | aagagtcaca | aagattcaac | 1140 |
| ccagtattct | tattgacatt | caatagaatc | taccatcaat | ctatgacctt | atcagatggc | 1200 |
| actaacattc | catctggaac | acgtattgct | gttccatcac | acgcaatgtt | gcaagattct | 1260 |
| gcacatgtcc | caggtccaac | cccacctact | gaatttgatg | gattcagata | tagtaagata | 1320 |
| cgttctgata | gtaactacgc | acaaaagtac | ctattctcca | tgaccgattc | ttcaaacatg | 1380 |
| gctttcggat | acggcaagta | tgcttgtcca | ggtagatttt | acgcgtctaa | tgagatgaaa | 1440 |
| ctaacattag | ccattttgtt | gctacaattt | gagttcaaac | taccagatgg | taaaggtcgt | 1500 |
| cctagaaata | tcactatcga | ttctgatatg | attccagacc | caagagctag | actttgcgtc | 1560 |
| agaaaaagat | cacttagaga | tgaatgaccg | cgg | | | 1593 |

SEQ ID NO: 72

| | | | | | |
|---|---|---|---|---|---|
| MSKSNSMNST | SHETLFQQLV | LGLDRMPLMD | VHWLIYVAFG | AWLCSYVIHV | LSSSSTVKVP | 60 |
| VVGYRSVFEP | TWLLRLRFVW | EGGSIIGQGY | NKFKDSIFQV | RKLGTDIVII | PPNYIDEVRK | 120 |
| LSQDKTRSVE | PFINDFAGQY | TRGMVFLQSD | LQNRVIQQRL | TPKLVSLTKV | MKEELDYALT | 180 |
| KEMPDMKNDE | WVEVDISSIM | VRLISRISAR | VFLGPEHCRN | QEWLTTTAEY | SESLFITGFI | 240 |
| LRVVPHILRP | FIAPLLPSYR | TLLRNVSSGR | RVIGDIIRSQ | QGDGNEDILS | WMRDAATGEE | 300 |
| KQIDNIAQRM | LILSLASIHT | TAMTMTHAMY | DLCACPEYIE | PLRDEVKSVV | GASGWDKTAL | 360 |
| NRFHKLDSFL | KESQRFNPVF | LLTFNRIYHQ | SMTLSDGTNI | PSGTRIAVPS | HAMLQDSAHV | 420 |
| PGPTPPTEFD | GFRYSKIRSD | SNYAQKYLFS | MTDSSNMAFG | YGKYACPGRF | YASNEMKLTL | 480 |
| AILLLQFEFK | LPDGKGRPRN | ITIDSDMIPD | PRARLCVRKR | SLRDE | | 525 |

SEQ ID NO: 73

| | | | | | |
|---|---|---|---|---|---|
| aagcttaaaa | tggaagatcc | tactgtctta | tatgcttgtc | ttgccattgc | agttgcaact | 60 |
| ttcgttgtta | gatggtacag | agatccattg | agatccatcc | caacagttgg | tggttccgat | 120 |
| ttgcctattc | tatcttacat | cggcgcacta | agatggacaa | gacgtggcag | agagatactt | 180 |
| caagagggat | atgatggcta | cagaggatct | acattcaaaa | tcgcgatgtt | agaccgttgg | 240 |
| atcgtgatcg | caaatggtcc | taaactagct | gatgaagtca | gacgtagacc | agatgaagag | 300 |
| ttaaactta | tggacggatt | aggagcattc | gtccaaacta | agtacaccct | aggtgaagct | 360 |
| attcataacg | atccatacca | tgtcgatatc | ataagagaaa | aactaacaag | aggccttcca | 420 |
| gccgtgcttc | ctgatgtcat | tgaagattgg | acacttgcag | ttagacagta | cattccaaca | 480 |
| gaaggtgatg | aatgggtgtc | cgtaaactgt | tcaaaggccg | caagagatat | tgttgctaga | 540 |
| gcttctaata | gagtctttgt | aggtttgcct | gcttgcagaa | accaaggtta | cttagatttg | 600 |
| gcaatagact | ttacattgtc | tgttgtcaag | gatagagcca | tcatcaatat | gtttccagaa | 660 |
| ttgttgaagc | caatagttgg | cagagttgta | ggtaacgcca | ccagaaatgt | tcgtagagct | 720 |
| gttccttttg | ttgctccatt | ggtggaggaa | agacgtagac | ttatggaaga | gtacggtgaa | 780 |
| gactggtctg | aaaaacctaa | tgatatgtta | cagtggataa | tggatgaagc | tgcatccaga | 840 |
| gatagttcag | tgaaggcaat | cgcagagaga | ttgttaatgg | tgaacttcgc | ggctattcat | 900 |
| acctcatcaa | acactatcac | tcatgctttg | taccaccttg | ccgaaatgcc | tgaaactttg | 960 |
| caaccactta | gagaagagat | cgaaccatta | gtcaaagagg | agggctggac | caaggctgct | 1020 |
| atgggaaaaa | tgtggtggtt | agattcattt | ctaagagaat | ctcaaagata | caatggcatt | 1080 |
| aacatcgtat | ctttaactag | aatggctgac | aaagatatta | cattgagtga | tggcacattt | 1140 |
| ttgccaaaag | tgactctagt | ggccgttcca | gcgtattcta | ctcatagaga | tgatgctgtc | 1200 |
| tacgctgatg | ccttagtatt | cgatccttc | agattctcac | gtatgagagc | gagagaaggt | 1260 |
| gaaggtacaa | agcaccagtt | cgttaatact | tcagtcgagt | acgttccatt | tggtcacgga | 1320 |
| aagcatgctt | gtccaggaag | attcttcgcc | gcaaacgaat | tgaaagcaat | gttggcttac | 1380 |
| attgttctaa | actatgatgt | aaagttgcct | ggtgacggta | aacgtccatt | gaacatgtat | 1440 |
| tggggtccaa | cagttttgcc | tgcaccagca | ggccaagtat | tgttcagaaa | agacaagtt | 1500 |
| agtctataac | cgcgg | | | | | 1515 |

SEQ ID NO: 74

| | | | | | |
|---|---|---|---|---|---|
| MEDPTVLYAC | LAIAVATFVV | RWYRDPLRSI | PTVGGSDLPI | LSYIGALRWT | RRGREILQEG | 60 |
| YDGYRGSTFK | IAMLDRWIVI | ANGPKLADEV | RRRPDEELNF | MDGLGAFVQT | KYTLGEAIHN | 120 |
| DPYHVDIIRE | KLTRGLPAVL | PDVIEELTLA | VRQYIPTEGD | EWVSVNCSKA | ARDIVARASN | 180 |
| RVFVGLPACR | NQGYLDLAID | FTLSVVKDRA | IINMFPELLK | PIVGRVVGNA | TRNVRRAVPF | 240 |
| VAPLVEERRR | LMEEYGEDWS | EKPNDMLQWI | MDEAASRDSS | VKAIAERLLM | VNFAAIHTSS | 300 |
| NTITHALYHL | AEMPETLQPL | REEIEPLVKE | EGWTKAAMGK | MWWLDSFLRE | SQRYNGINIV | 360 |
| SLTRMADKDI | TLSDGTFLPK | GTLVAVPAYS | THRDDAVYAD | ALVFDPFRFS | RMRAREGEGT | 420 |
| KHQFVNTSVE | YVPFGHGKHA | CPGRFFAANE | LKAMLAYIVL | NYDVKLPGDG | KRPLNMYWGP | 480 |
| TVLPAPAGQV | LFRKRQVSL | | | | | 499 |

SEQ ID NO: 75

| | | | | | |
|---|---|---|---|---|---|
| atggcatttt | tctctatgat | ttcaattttg | ttgggatttg | ttatttcttc | tttcatcttc | 60 |
| atctttttct | tcaaaaagtt | acttagtttt | agtaggaaaa | acatgtcaga | agtttctact | 120 |
| ttgccaagtg | ttccagtagt | gcctggtttt | ccagttattg | gaatttgtt | gcaactaaag | 180 |
| gagaaaaagc | ctcataaaac | tttcactaga | tggtcagaa | tatatggaca | tatctactct | 240 |
| ataaagatgg | gttcttcatc | tcttattgta | ttgaacagta | cagaaactgc | taaggaagca | 300 |
| atggtcacta | gattttcatc | aatatctacc | agaaaattgt | caaacgccct | aacagttcta | 360 |
| acctgcgata | agtctatggt | cgccacttct | gattatgatg | acttccacaa | attagttaag | 420 |
| agatttggc | taaatggact | tcttggtgct | aatgctcaaa | aggagaaaag | acactacaga | 480 |
| gatgctttga | ttgaaaatgt | gagttccaag | ctacatgcac | acgctagaga | tcatccacaa | 540 |
| gagccagtta | acttagagc | aattttcgaa | cacgaattgt | ttggtgtagc | attaaagcaa | 600 |
| gccttcggta | aagacgtaga | atccatatac | gtcaaggagt | taggcgtaac | attatcaaaa | 660 |
| gatgaaatct | ttaaggtgct | tgtacatgat | atgatggagg | gtgcaattga | tgtagattgg | 720 |
| agagatttct | tcccatattt | gaaatggatc | cctaataagt | cttttgaagc | taggatacaa | 780 |

TABLE 10-continued

Sequences disclosed herein.

```
caaaagcaca agagaagact agctgttatg aacgcactta tacaggacag attgaagcaa    840
aatgggtctg aatcagatga tgattgttac cttaacttct taatgtctga ggctaaaaca    900
ttgactaagg aacagatcgc aatccttgtc tgggaaacaa tcattgaaac agcagatact    960
accttagtca caactgaatg ggccatatac gagctagcca acatccatc tgtgcaagat   1020
aggttgtgta aggagatcca gaacgtgtgt ggtggagaga aattcaagga agagcagttg   1080
tcacaagttc cttaccttaa cggcgttttc catgaaacct tgagaaaata ctcacctgca   1140
ccattagttc ctattagata cgcccacgaa gatacacaga tcggtggcta ccatgttcca   1200
gctgggtccg aaattgctat aaacatctac gggtgcaaca tggacaaaaa gagatgggaa   1260
agaccagaag attggtggcc agaaagattc ttagatgatg gcaaatatga acatctgat   1320
ttgcataaaa caatggcttt cggagctggc aaaagagtgt gtgccggtgc tctacaagcc   1380
tccctaatgg ctggtatcgc tattggtaga ttggtccaag agttcgaatg gaaacttaga   1440
gatggtgaag aggaaaatgt cgatacttat ggttaacat ctcaaaagtt atcccacta   1500
atggcaatca tcaatcctag aagatcctaa                                    1530
```

SEQ ID NO: 76

```
MAFFSMISIL LGFVISSFIF IFFFKKLLSF SRKNMSEVST LPSVPVVPGF PVIGNLLQLK    60
EKKPHKTFTR WSEIYGPIYS IKMGSSSLIV LNSTETAKEA MVTRFSSIST RKLSNALTVL   120
TCDKSMVATS DYDDFHKLVK RCLLNGLLGA NAQKRKRHYR DALIENVSSK LHAHARDHPQ   180
EPVNFRAIFE HELFGVALKQ AFGKDVESIY VKELGVTLSK DEIFKVLVHD MMEGAIDVDW   240
RDFFPYLKWI PNKSFEARIQ QKHKRRLAVM NALIQDRLKQ NGSESDDDCY LNFLMSEAKT   300
LTKEQIAILV WETIIETADT TLVTTEWAIY ELAKHPSVQD RLCKEIQNVC GGEKFKEEQL   360
SQVPYLNGVF HETLRKYSPA PLVPIRYAHE DTQIGGYHVP AGSEIAINIY GCNMDKKRWE   420
RPEDWWPERF LDDGKYETSD LHKTMAFGAG KRVCAGALQA SLMAGIAIGR LVQEFEWKLR   480
DGEEENVDTY GLTSQKLYPL MAIINPRRS                                     509
```

SEQ ID NO: 77

```
atgcaatcag attcagtcaa agtctctcca tttgatttgg tttccgctgc tatgaatggc    60
aaggcaatgg aaaagttgaa cgctagtgaa tctgaagatc caacaacatt gcctgcacta   120
aagatgctag ttgaaaatag agaattgttg acactgttca caacttcctt cgcagttctt   180
attgggtgtc ttgtatttct aatgtggaga cgttcatcct ctaaaaagct ggtacaagat   240
ccagttccac aagttatcgt tgtaaagaag aaagagaagg agtcagaggt tgatgacggg   300
aaaaagaaag tttctatttt ctacggcaca caaacaggaa ctgccgaagg ttttgctaaa   360
gcattagtcg aggaagcaaa agtgagatat gaaaagacct ctttcaaggt tatcgatcta   420
gatgactacg ctgcagatga tgatgaatat gaggaaaaac tgaaaaagga atccttagcc   480
ttcttcttct tggccacata cggtgatggt gaacctactg ataatgctgc taacttctac   540
aagtggttca cagaaggcga cgataaaggt gaatggctga aaaagttaca atacggagta   600
tttggtttag gtaacagaca atatgaacat ttcaacaaga tcgctattgt agttgatgat   660
aaacttactg aaatgggagc caaaagatta gtaccagtag gattagggga tgatgatcag   720
tgtatagaag atgacttcac cgcctgaaag gaattggtat ggccagaatt ggatcaactt   780
ttaagggacg aagatgatac ttctgtgact accccataca ctgcagccgt attggagtac   840
agagtggttt accatgataa accagcagac tcatatgctg aagatcaaac ccatacaaac   900
ggtcatgttg ttcatgatgc acagcatcct tcaagatcta atgtggcttt caaaaaggaa   960
ctacacacct ctcaatcaga taggtcttgt actcacttag aattcgatat ttctcacaca  1020
ggactgtctt acgaaactgg cgatcacgtt ggcgtttatt ccgagaactt gtccgaagtt  1080
gtcgatgaag cactaaaaact gttagggtta tcaccagaca catacttctc agtccatgct  1140
gataaggagg atgggacacc tatcggtggt gcttcactac caccaccttt tcctcctgcc  1200
acattgagag acgctctaac cagatacgca gatgtcttat cctcacctaa aaaggtagct  1260
ttgctggcat tggctgctca tgctagtgat cctagtgaag ccgataggtt aaagttcctg  1320
gcttcaccag ccggaaaaga tgaatatgca caatggatcg tcgccaacca acgttctttg  1380
ctagaagtga tgcaaagttt tccatctgcc aagcctccat taggtgtgtt cttcgcagca  1440
gtagctccac gtttacaacc aagatactac tctatcagtt catctcctaa gatgtctcct  1500
aacagaatac atgttacatg tgctttggtg tacgagacta ctccagcagg cagaattcac  1560
agaggattgt gttcaacctg gatgaaaaat gctgtcccct taacagagtc acctgattgc  1620
tctcaagcat ccattttcgt tagaacatca aatttcgac ttccagtgga tccaaaagtt  1680
ccagtcatta tgataggacc aggtactggt cttgcccat caggggctt tcttcaagag  1740
agattggcct tgaaggaatc tggtacagaa ttgggttctt ctatcttttt ctttggttgc  1800
cgtaatagaa aagttgactt tatctacgag gacgagctta acaattttgt tgagacagga  1860
gcattgtcag aattgatcgt cgcatttca agagaaggga ctgccaaaga gtacgttcag  1920
cacaagatga gtcaaaaagc ctccgatata tggaaacttc taagtgaagg tgcctatctt  1980
tatgtctgtg gcgatgcaaa gggcatggcc aaggatgtcc atagaactct gcatacaatt  2040
gttcaggaac aagggagtct ggattcttcc aaggctgaat tgtacgtcaa aaacttacag  2100
atgtctggaa gatacttaag agatgtttgg taa                                2133
```

SEQ ID NO: 78

```
MQSDSVKVSP FDLVSAAMNG KAMEKLNASE SEDPTTLPAL KMLVENRELL TLFTTSFAVL    60
IGCLVFLMWR RSSSKKLVQD PVPQVIVVKK KEKESEVDDG KKKVSIFYGT QTGTAEGFAK   120
ALVEEAKVRY EKTSFKVIDL DDYAADDDEY EEKLKKESLA FFFLATYGDG EPTDNAANFY   180
KWFTEGDDKG EWLKKLQYGV FGLGNRQYEH FNKIAIVVDD KLTEMGAKRL VPVGLGDDDQ   240
CIEDDFTAWK ELVWPELDQL LRDEDDTSVT TPYTAAVLEY RVVYHDKPAD SYAEDQTHTN   300
GHVVHDAQHP SRSNVAFKKE LHTSQSDRSC THLEFDISHT GLSYETGDHV GVYSENLSEV   360
VDEALKLLGL SPDTYFSVHA DKEDGTPIGG ASLPPPFPPC TLRDALTRYA DVLSSPKKVA   420
LLALAAHASD PSEADRLKFL ASPAGKDEYA QWIVANQRSL LEVMQSFPSA KPPLGVFFAA   480
VAPRLQPRYY SISSSPKMSP NRIHVTCALV YETTPAGRIH RGLCSTWMKN AVPLTESPDC   540
SQASIFVRTS NFRLPVDPKV PVIMIGPGTG LAPFRGFLQE RLALKESGTE LGSSIFFFGC   600
```

TABLE 10-continued

Sequences disclosed herein.

| | | | | |
|---|---|---|---|---|
| RNRKVDFIYE | DELNNFVETG | ALSELIVAFS | REGTAKEYVQ | HKMSQKASDI |
| WKLLSEGAYL | | | | 660 |
| YVCGDAKGMA | KDVHRTLHTI | VQEQGSLDSS | KAELYVKNLQ | MSGRYLRDVW | 710 |

SEQ ID NO: 79

```
atgaaggtca gtccattcga attcatgtcc gctattatca agggtagaat ggacccatct    60
aactcctcat ttgaatctac tggtgaagtt gcctccgtta tctttgaaaa cagagaattg   120
gttgccatct tgaccacttc tattgctgtt atgattggtt gcttcgttgt cttgatgtgg   180
agaagagctg gttctagaaa ggttaagaat gtcgaattgc caaagccatt gattgtccat   240
gaaccagaac ctgaagttga agatggtaag aagaaggttt ccatcttctt cggtactcaa   300
actggtactg ctgaaggttt tgctaaggct ttggctgatg aagctaaagc tagatacgaa   360
aaggctacct tcagagttgt tgatttggat gattatgctg ccgatgatga ccaatacgaa   420
gaaaaattga gaacgaatc cttcgccgtt ttccttgttgg ctacttatgg tgatggtgaa   480
cctactgata atgctgctag attttacaag tggttcgccg aaggtaaaga aagaggtgaa   540
tggttgcaaa acttgcacta tgctgttttt ggtttgggta acagacaata cgaacacttc   600
aacaagattg ctaaggttgc cgacgaatta ttggaagctc aaggtggtaa tagattggtt   660
aaggttggtt taggtgatga cgatcaatgc atcgaagatg attttctgc ttggagagaa   720
tctttgtggc cagaattgga tatgttgttg agagatgaag atgatgctac tactgttact   780
actccatata ctgctgctgt cttggaatac agagttgtct ttcatgattc tgctgatgtt   840
gctgctgaag ataagtcttg gattaacgct aatggtcatg ctgttcatga tgctcaacat   900
ccattcagat ctaacgttgt cgtcagaaaa gaattgcata cttctgcctc tgatagatcc   960
tgttctcatt tggaattcaa catttccggt tccgctttga attacgaaac tggtgatcat  1020
gttggtgtct actgtgaaaa cttgactgaa actgttgata agccttgaa cttgttgggt  1080
ttgtctccag aaacttactt ctctatctac accgataacg aagatggtac tccattgggt  1140
ggttcttcat tgccaccacc atttccatca tgtactttga gaactgcttt gaccagatac  1200
gctgatttgt tgaactctcc aaaaaagtct gctttgttgg ctttagctgc tcatgcttct  1260
aatccagttg aagctgatag attgagatac ttggcttctc cagctggtaa agatgaatat  1320
gcccaatctg ttatcggttc ccaaaagtct ttgttggaag ttatggctga attcccatct  1380
gctaaaccac cattaggtgt tttttttgct gctgttgctc caagattgca acctagattc  1440
tactccattt catcctctcc aagaatggct ccatctagaa tccatgttac ttgtgctttg  1500
gtttacgata agatgccaac tggtagaatt cataagggtg tttgttctac ctggatgaag  1560
aattctgttc caatggaaaa gtcccatgaa tgttcttggg ctccaatttt cgttagacaa  1620
tccaattta agttgccagc cgaatccaag gttccaatta tcatggttgg tccaggtact  1680
ggtttggctc cttttagagg ttttttacaa gaaagattgg ccttgaaaga atccggtgtt  1740
gaattgggtc catccattt gttttcggt tgcagaaaca gaagaatgga ttacatctac  1800
gaagatgaat tgaacaactt cgttgaaacc ggtgcttgt ccgaattgt tattgctttt  1860
tctagagaag gtcctaccaa agaatacgtc caacataaga tggctgaaaa ggcttctgat  1920
atctggaact tgatttctga aggtgcttac ttgtacgttt gtggtgatgc taaaggtatg  1980
gctaaggatg ttcatagaac cttgcatacc atcatgcaag aacaaggttc tttggattct  2040
tccaaagctg aatccatggt caagaacttg caaatgaatg gtagatactt aagagatgtt  2100
tggtaa                                                              2106
```

SEQ ID NO: 80

```
MKVSPFEFMS AIIKGRMDPS NSSFESTGEV ASVIFENREL VAILTTSIAV MIGCFVVLMW    60
RRAGSRKVKN VELPKPLIVH EPEPEVEDGK KKVSIFFGTQ TGTAEGFAKA LADEAKARYE   120
KATFRVVDLD DYAADDDQYE EKLKNESFAV FLLATYGDGE PTDNAARFYK WFAEGKERGE   180
WLQNLHYAVF GLGNRQYEHF NKIAKVADEL LEAQGGNRLV KVGLGDDDQC IEDDFSAWRE   240
SLWPELDMLL RDEDDATTVT TPYTAAVLEY RVVFHDSADV AAEDKSWINA NGHAVHDAQH   300
PFRSNVVVRK ELHTSASDRS CSHLEFNISG SALNYETGDH VGVYCENLTE TVDEALNLLG   360
LSPETYFSIY TDNEDGTPLG GSSLPPPFPS CTLRTALTRY ADLLNSPKKS ALLALAAHAS   420
NPVEADRLRY LASPAGKDEY AQSVIGSQKS LLEVMAEFPS AKPPLGVFFA AVAPRLQPRF   480
YSISSSPRMA PSRIHVTCAL VYDKMPTGRI HKGVCSTWMK NSVPMEKSHE CSWAPIFVRQ   540
SNFKLPAESK VPIIMVGPGT GLAPFRGFLQ ERLALKESGV ELGPSILFFG CRNRRMDYIY   600
EDELNNFVET GALSELVIAF SREGPTKEYV QHKMAEKASD IWNLISEGAY LYVCGDAKGM   660
AKDVHRTLHT IMQEQGSLDS SKAESMVKNL QMNGRYLRDV W                       701
```

SEQ ID NO: 81

```
atggcagaat tagatacact tgatatagta gtattaggtg ttatcttttt gggtactgtg    60
gcatacttta ctaagggtaa atttgtgggt gttaccaagg atccatcagc taacggattc   120
gctgcaggtg gtgcttccaa gcctggcaga actagaaaca tcgtcgaagc tatggaggaa   180
tcaggtaaaa actgtgttgt tttctacggc agtcaaacag gtacagcgga ggattacgca   240
tcaagacttg caaaggaagg aaagtccaga ttcggtttga acactatgat cgccgatcta   300
gaagattatg acttcgataa cttagacact gttccatcga ataacatcgt tatgtttgta   360
ttggctactt acgttgaagg cgaaccaaca gataacgccg tggatttcta tgagttcatt   420
actggcgaag atgcctcttt caatgagggc aacgatcctc cactaggtaa cttgaattac   480
gttgcgttcg gtctgggcaa caatacctac gaacactaca actcaatggt caggaacgtt   540
aacaaggctc tagaaaagtt aggagctcat agaattggaa cagaagttgg gggtgacgac   600
ggagctggaa ctatggaaga ggactttta gcttggaaag atccaatgtg ggaagccttg   660
gctaaaaaga tgggcttgga ggaaagagaa gctgtatatg aacctatttt cgctatcaat   720
gagagagatg atttgacccc tgaagcgaat gaggtatact gggagaacc taataagcta   780
cacttggaag gtacagcgaa aggtccattc aactcccaca cccatatat cgcaccaatt   840
gcagaatcat acgaactttt ctcagctaag gatagaaatt gtctgcatat ggaaattgat   900
atttctggta gtaatctaaa gtatgaaaca ggcgaccata tcgcgatctg gcctaccaac   960
ccaggtgaag aggtcaacaa atttcttgac attctagatc tgtctggtaa gcaacattcc  1020
gtcgtaacag tgaaagcctt agaacctaca gccaaagttc cttttccaaa tccaactacc  1080
tacgatgcta tattgagata ccatctggaa atatgcgctc cagtttctag acagtttgtc  1140
```

TABLE 10-continued

Sequences disclosed herein.

```
tcaactttag cagcattcgc ccctaatgat gatatcaaag ctgagatgaa ccgtttggga    1200
tcagacaaag attacttcca cgaaaagaca ggaccacatt actacaatat cgctagattt    1260
ttggcctcag tctctaaagg tgaaaaatgg acaaagatac cattttctgc tttcatagaa    1320
ggccttacaa aactacaacc aagatactat tctatctctt cctctagttt agttcagcct    1380
aaaaagatta gtattactgc tgttgtcgaa tctcagcaaa ttccaggtag agatgaccca    1440
ttcagaggtg tagcgactaa ctacttgttc gctttgaagc agaaacaaaa cggtgatcca    1500
aatccagctc cttttggcca atcatacgag ttgacaggac caaggaataa gtatgatggt    1560
atacatgttc cagtccatgt aagacattct aactttaagc taccatctga tccaggcaaa    1620
cctattatca tgatcggtcc aggtaccggt gttgcccctt ttagaggctt cgtccaagag    1680
agggcaaaac aagccagaga tggtgtagaa gttggtaaaa cactgctgtt ctttggatgt    1740
agaaagagta cagaagattt catgtatcaa aaagagtggc aagagtacaa ggaagctctt    1800
ggcgacaaat tcgaaatgat tacagctttt tcaagagaag gatctaaaaa ggtttatgtt    1860
caacacagac tgaaggaaag atcaaggaaa gtttctgatc ttctatccca aaaagcatac    1920
ttctacgttt gcggagacgc cgcacatatg gcacgtgaag tgaacactgt gttagcacag    1980
atcatagcag aaggccgtgg tgtatcagaa gccaagggtg aggaaattgt caaaaacatg    2040
agatcagcaa atcaatacca agtgtgttct gatttcgtaa ctttacactg taagagaca    2100
acatacgcga attcagaatt gcaagaggat gtctggagtt aa                       2142
```

SEQ ID NO: 82

```
MAELDTLDIV VLGVIFLGTV AYFTKGKLWG VTKDPYANGF AAGGASKPGR TRNIVEAMEE     60
SGKNCVVFYG SQTGTAEDYA SRLAKEGKSR FGLNTMIADL EDYDFDNLDT VPSDNIVMFV    120
LATYGEGEPT DNAVDFYEFI TGEDASFNEG NDPPLGNLYN VAFGLGNNTY EHYNSMVRNV    180
NKALEKLGAH RIGEAGEGDD GAGTMEEDFL AWKDPMWEAL AKKMGLEERE AVYEPIFAIN    240
ERDDLTPEAN EVYLGEPNKL HLEGTAKGPF NSHNPYIAPI AESYELFSAK DRNCLHMEID    300
ISGSNLKYET GDHIAIWPTN PGEEVNKFLD ILDLSGKQHS VVTVKALEPT AKVPFPNPTT    360
YDAILRYHLE ICAPVSRQFV STLAAFAPND DIKAEMNRLG SDKDYFHEKT GPHYYNIARF    420
LASVSKGEKW TKIPFSAFIE GLTKLQPRYY SISSSSLVQP KKISITAVVE SQQIPGRDDP    480
FRGVATNYLF ALKQKQNGDP NPAPFGQSYE LTGPRNKYDG IHVPVHVRHS NFKLPSDPGK    540
PIIMIGPGTG VAPFRGFVQE RAKQARDGVE VGKTLLFFGC RKSTEDFMYQ KEWQEYKEAL    600
GDKFEMITAF SREGSKKVYV QHRLKERSKE VSDLLSQKAY FYVCGDAAHM AREVNTVLAQ    660
IIAEGRGVSE AKGEEIVKNM RSANQYQVCS DFVTLHCKET TYANSELQED VWS           713
```

SEQ ID NO: 83

```
atgcaatcgg aatccgttga agcatcgacg attgatttga tgactgctgt tttgaaggac     60
acagtgatcg atacagcgaa cgcatctgat aacggagact caaagatgcc gccggcgttg    120
gcgatgatgt tcgaaattcg tgatctgttg ctgattttga ctacgtcagt tgctgttttg    180
gtcggatgtt tcgttgtttt ggtgtggaag agatcgtccg ggaagaagtc cggcaaggaa    240
ttggagccgc cgaagatcgt tgtgccgaag aggcggctgg agcaggaggt tgatgatggt    300
aagaagaagg ttacgatttt cttcggaaca caaactggaa cggctgaagg tttcgctaag    360
gcactttcg aagaagcgaa agcgcgatat gaaaaggcag cgtttaaagt gattgatttg    420
gatgattatg ctgctgattt ggatgagtat gcagagaagc tgaagaagga acatatgct     480
ttcttcttct tggctacata tggagatggt gagccaactg atatgctgc caaatttat     540
aaaatggttta ctgagggaga cgagaaaggc gtttggcttc aaaaacttca atatggagta    600
tttggtcttg gcaacagaca atatgaacat tcaacaaga ttggaatagt ggttgatgat     660
ggtctcaccg agcagggtgc aaaacgcatt gttccgttg tcttggaga cgacgatcaa     720
tcaattgaag acgatttttc ggcatggaaa gagttagtgt ggcccgaatt ggatctattg    780
cttcgcgatg aagatgacaa agctgctgca actccttaca cagctgcaat ccctgaatac    840
cgcgtcgtat tcatgacaa acccgatgcg ttttctgatg atcatactca aaccaatggt    900
catgctgttc atgatgctca acatccatgc agatccaatg tggctgttaa aaaagagctt    960
catactcctg aatccgatcg ttcatgcaca catcttgaat ttgacatttc tcacactgga   1020
ttatcttatg aaactggga tcatgttggt gtatactgtg aaaacctaat tgaagtagtg   1080
gaagaagctg ggaaattgtt aggattatca acagatactt atttctcgtt acatattgat   1140
aacgaagatg gttcaccact tggtggacct tcattacaac ctccttttcc tccttgtact   1200
ttaagaaaag cattgactaa ttatgcagat ctgttaagct ctcccaaaaa gtcaactttg   1260
cttgctctag ctgctcatgc ttccgatccc actgaagctg atcgtttaag atttcttgca   1320
tctcgcgagg gcaaggatga atatgctgaa tgggttgttg caaaccaaag aagtcttctt   1380
gaagtcatgg aagcttccc gtcagctaga ccgccacttg tgttttctt tgcagcggtt   1440
gcaccgcgtt tacagcctcg ttactactct atttcttcct ccccaaagat ggaaccaaac   1500
aggattcatg ttactgcgc gttggtttat gaaaaaactc ccgcaggtcg tatccacaaa   1560
ggaatctgct caacctggat gaagaacgct gtacctttga ccgaaagtca agattgcagt   1620
tgggcaccga ttttttgttag aacatcaaac ttcagacttc caattgaccc gaaagtcccg   1680
gttatcatga ttggtcctgg aaccggggttg gctccattta ggggtttttct tcaagaaga   1740
ttggctctta aagaatccgg aaccgaactc ggtgtcatca ttttattctt cggttgtaga   1800
aaccgcaaag tggattacat atatgagaat gaactcaaca actttgttga aaatggtgcg   1860
cttttctgagc ttgatgttgc tttctcccgc gatggcccga cgaaagaata cgtgcaacat   1920
aaaatgaccc aaaaggcttc tgaaatatgg aatatgcttt ctgagggagc atatttatat   1980
gtatgtggtg atgctaaagg catggctaaa gatgtacacc gtacacttca caccattgtg   2040
caagaacagg gaagtttgga ctcgtctaaa gcggagttgt atgtgaagaa tctacaaatg   2100
tcaggaagat acctccgtga tgtttggtaa                                    2130
```

SEQ ID NO: 84

```
MQSESVEAST IDLMTAVLKD TVIDTANASD NGDSKMPPAL AMMFEIRDLL LILTTSVAVL     60
VGCFVVLVWK RSSGKKSGKE LEPPKIVVPK RRLEQEVDDG KKKVTIFFGT QTGTAEGFAK    120
ALFEEAKARY EKAAFKVIDL DDYAADLDEY AEKLKKETYA FFFLATYGDG EPTDNAAKFY    180
KWFTEGDEKG VWLQKLQYGV FGLGNRQYEH FNKIGIVVDD GLTEQGAKRI VPVGLGDDDQ    240
```

TABLE 10-continued

Sequences disclosed herein.

| | | | | | |
|---|---|---|---|---|---|
| SIEDDFSAWK | ELVWPELDLL | LRDEDDKAAA | TPYTAAIPEY | RVVFHDKPDA | FSDDHTQTNG | 300 |
| HAVHDAQHPC | RSNVAVKKEL | HTPESDRSCT | HLEFDISHTG | LSYETGDHVG | VYCENLIEVV | 360 |
| EEAGKLLGLS | TDTYFSLHID | NEDGSPLGGP | SLQPPFPPCT | LRKALTNYAD | LLSSPKKSTL | 420 |
| LALAAHASDP | TEADRLRFLA | SREGKDEYAE | WVVANQRSLL | EVMEAFPSAR | PPLGVFFAAV | 480 |
| APRLQPRYYS | ISSSPKMEPN | RIHVTCALVY | EKTPAGRIHK | GICSTWMKNA | VPLTESQDCS | 540 |
| WAPIFVRTSN | FRLPIDPKVP | VIMIGPGTGL | APFRGFLQER | LALKESGTEL | GSSILFFGCR | 600 |
| NRKVDYIYEN | ELNNFVENGA | LSELDVAFSR | DGPTKEYVQH | KMTQKASEIW | NMLSEGAYLY | 660 |
| VCGDAKGMAK | DVHRTLHTIV | QEQGSLDSSK | AELYVKNLQM | SGRYLRDVW | | 709 |

SEQ ID NO: 85

```
atgcaatcta actccgtgaa gatttcgccg cttgatctgg taactgcgct gtttagcggc      60
aaggttttgg acacatcgaa cgcatcggaa tcgggagaat ctgctatgct gccgactata     120
gcgatgatta tggagaatcg tgagctgttg atgatactca aacgtcggt tgctgtattg     180
atcggatgcg ttgtcgtttt ggtgtggcgg agatcgtcta cgaagaagtc ggcgttggag     240
ccaccggtga ttgtggttcc gaagagagtg caagaggagg aagttgatga tggtaagaag     300
aaagttacgg tttttcttcgg cacccaaact ggaacagctg aaggcttcgc taaggcactt     360
gttgaggaag ctaaagctcg atatgaaaag gctgtcttta agtaattga tttggatgat     420
tatgctgctg atgacgatga gtatgaggag aaactaaaga aagaatcttt ggccttttc     480
ttttttgcta cgtatggaga tggtgagcca acagataatg ctgccagatt ttataaatgg     540
tttactgagg gagatgcgaa aggagaatgg cttaataagc ttcaatatgg agtatttggt     600
ttgggtaaca gacaatatga acatttttaac aagatcgcaa aagtggttga tgatggtctt     660
gtagaacagg gtgcaaagcg tcttgttcct gttggacttg aggatgatga tcaatgtatt     720
gaagatgact tcaccgcatg gaaagagtta gtatggccgg agttggatca attacttcgt     780
gatgaggatg acacaactgt tgctactcca tacacagctg ctgttgcaga atatcgcgtt     840
gtttttcatg aaaaaccaga cgcgctttct gaagattata gttatacaaa tggccatgct     900
gttcatgatg ctcaacatcc atgcagatcc aacgtggctg tcaaaaagga acttcatagt     960
cctgaatctg accggtcttg cactcatctt gaatttgaca tctcgaacac cggactatca    1020
tatgaaactg gggaccatgt tggagtttac tgtgaaaact tgagtgaagt tgtgaatgat    1080
gctgaaagat tagtaggatt accaccagac acttactcct ccatccacac tgatagtgaa    1140
gacgggtcgc cacttggcgg agcctcattg ccgcctcctt tcccgccatg cacttaagg    1200
aaagcattga cgtgttatgc tgatgtttta gttctccaca agaagtcggc tttgcttgca    1260
ctagctgctc atgccaccga tcccagtgaa gctgatagat tgaaatttct tgcatccccc    1320
gccgaaaagg atgaatattc tcaatggata gttgcaagcc aaagaagtct ccttgaagtc    1380
atggaagcat tcccgtcagc taagccttca cttggtgttt tctttgcatc tgttgccccg    1440
cgcttacaac aagatacta ctctatttct tcctcaccca agatggccac ggataggatt    1500
catgttacat gtgcattagt ctatgagaaa acacctgcag gccgcatcca caaaggagtt    1560
tgttcaactt ggatgaagaa cgcagtgcct atgaccgaga gtcaagattg cagttgggcc    1620
ccaatatacg tccgaacatc caatttcaga ctaccatctg accctaaggt cccggttatc    1680
atgattggac ctggcactgg tttggctcct tttagagatt tccttcaaga gcggttagct    1740
ttaaaggaag ccggaactga cctcggttta tccatttat tcttcggatg taggaatcgc    1800
aaagtggatt tcatatatga aaacgagctt aacaactttg tggagactgg tgctctttct    1860
gagcttattg ttgcttcttc ccgtgaaggc ccgactaagg aatatgtgca acacaagatg    1920
agtgaagagg cttcggatat ctggaacttg cttttctgaag gagcatattt atacgtatgt    1980
ggtgatgcca aaggcatggc caaagatgta catcgaaccc tccacacaat tgtgcaagaa    2040
cagggatctc ttgactcgtc aaaggcagaa ctctacgtga agaatctaca aatgtcagga    2100
agataccctcc gtgacgtttg gtaa                                           2124
```

SEQ ID NO: 86

| | | | | | |
|---|---|---|---|---|---|
| MQSNSVKISP | LDLVTALFSG | KVLDTSNASE | SGESAMLPTI | AMIMENRELL | MILTTSVAVL | 60 |
| IGCVVVLVWR | RSSTKKSALE | PPVIVVPKRV | QEEEVDDGKK | KVTVFFGTQT | GTAEGFAKAL | 120 |
| VEEAKARYEK | AVFKVIDLDD | YAADDDEYEE | KLKKESLAFF | FLATYGDGEP | TDNAARFYKW | 180 |
| FTEGDAKGEW | LNKLQYGVFG | LGNRQYEHFN | KIAKVVDDGL | VEQGAKRLVP | VGLGDDDQCI | 240 |
| EDDFTAWKEL | VWPELDQLLR | DEDDTTVATP | YTAAVAEYRV | VFHEKPDALS | EDYSYTNGHA | 300 |
| VHDAQHPCRS | NVAVKKELHS | PESDRSCTHL | EFDISNTGLS | YETGDHVGVY | CENLSEVVND | 360 |
| AERLVGLPPD | TYSSIHTDSE | DGSPLGGASL | PPPFPPCTLR | KALTCYADVL | SSPKKSALLA | 420 |
| LAAHATDPSE | ADRLKFLASP | AGKDEYSQWI | VASQRSLLEV | MEAFPSAKPS | LGVFFASVAP | 480 |
| RLQPRYYSIS | SSPKMAPDRI | HVTCALVYEK | TPAGRIHKGV | CSTWMKNAVP | MTESQDCSWA | 540 |
| PIYVRTSNFR | LPSDPKVPVI | MIGPGTGLAP | FRGFLQERLA | LKEAGTDLGL | SILFFGCRNR | 600 |
| KVDFIYENEL | NNFVETGALS | ELIVAFSREG | PTKEYVQHKM | SEKASDIWNL | LSEGAYLYVC | 660 |
| GDAKGMAKDV | HRTLHTIVQE | QGSLDSSKAE | LYVKNLQMSG | RYLRDVW | | 707 |

SEQ ID NO: 87

```
atgtcctcca actccgattt ggtcagaaga ttggaatctg ttttgggtgt ttctttcggt      60
ggttctgtta ctgattccgt tgttgttatt gctaccacct ctattgcttt ggttatcggt     120
gttttggttt tgttgtggag aagatcctct gacagatcta gagaagttaa gcaattggct     180
gttccaaagc cagttactat cgttgaagaa gaagtgaat tcgaagttgc ttctggtaag     240
accagagttt ctattttcta cggtactcaa actggtactg ctgaaggttt tgctaaggct     300
ttggctgaag aaatcaaagc cagatacgaa aagctgccg ttaaggttat tgatttggat     360
gattacacag ccgaagatga caaatacggt gaaaagttga gaaagaaac tatggccttc     420
tcatgttgg ctacttatgg tgatggtgaa cctactgata atgctgctaa atttacaag     480
tggttcaccg aaggtactga taggggtgtt tggttggaac atttgagata cggtgtattc     540
ggtttgggta acagacaata cgaacacttc aacaagattg ccaaggttgt tgatgatttg     600
ttggttgaac aaggtgccaa agagattgtt actgttggtt tggtgatga tgatcaatgc     660
atcgaagatg atttctccgc ttggaaagaa gccttgtggc cagaattgga tcaattattg     720
caagatgata ccaacaccgt ttctactcca tacactgctg ttattccaga atacagagtt    780
```

TABLE 10-continued

Sequences disclosed herein.

| | | | | |
|---|---|---|---|---|
| gttatccacg | atccatctgt | tacctcttat | gaagatccat | actctaacat ggctaacggt | 840 |
| aatgcctctt | acgatattca | tcatccatgt | agagctaacg | ttgccgtcca aaaagaattg | 900 |
| cataagccag | aatctgacag | aagttgcatc | catttggaat | tcgatatttt cgctactggt | 960 |
| ttgacttacg | aaaccggtga | tcatgttggt | gtttacgctg | ataattgtga tgatactgta | 1020 |
| gaagaagcca | ctaagttgtt | gggtcaacca | ttggatttgt | tgttctccat tcataccgat | 1080 |
| aacaacgacg | tacttctttt | gggttcttct | ttgccaccac | catttccagg tccatgtact | 1140 |
| ttgagaactg | ctttggctag | atatgccgat | ttgttgaatc | caccaaaaaa ggctgctttg | 1200 |
| attgctttag | ctgctcatgc | tgatgaacca | tctgaagctg | aaagattgaa gttcttgtca | 1260 |
| tctccacaag | gtaaggacga | atattctaaa | tgggttgtcg | gttcccaaag atccttggtt | 1320 |
| gaagttatgg | ctgaatttcc | atctgctaaa | ccaccattgg | gtgtatttt tgctgctgtt | 1380 |
| gttcctagat | tgcaacctag | atattactcc | atctcttcca | gtccaagatt tgctccacat | 1440 |
| agagttcatg | ttacttgcgc | tttggtttat | ggtccaactc | caactggtag aattcacaga | 1500 |
| ggtgtatgtt | cattctggat | gaagaatgtt | gtcccattgg | aaaagtctca aaactgttct | 1560 |
| tgggccccaa | ttttcatcag | acaatctaat | ttcaagttgc | cagccgatca ttctgttcca | 1620 |
| atagttatgg | ttggtccagg | tactggttta | gctccttta | gaggtttctt acaagaaaga | 1680 |
| ttggccttga | aagaagaagg | tgctcaagtt | ggtcctgctt | tgttgttttt tggttgcaga | 1740 |
| aacagacaaa | tggacttcat | ctacgaagtc | gaattgaaca | actttgtcga acaaggtgct | 1800 |
| ttgtccgaat | tgatcgttgc | tttttcaaga | gaaggtccat | ccaaagaata cgtccaacat | 1860 |
| aagatggttg | aaaaggcagc | ttacatgtgg | aacttgattt | ctcaaggtgg ttacttctac | 1920 |
| gtttgtggtg | atgctaaagg | tatggctaga | gatgttcata | gaacattgca taccatcgtc | 1980 |
| caacaagaag | aaaaggttga | ttctaccaag | gccgaatcca | tcgttaagaa attgcaaatg | 2040 |
| gacggtagat | acttgagaga | tgtttggtga | | | 2070 |

SEQ ID NO: 88

| | | | | |
|---|---|---|---|---|
| MSSNSDLVRR | LESVLGVSFG | GSVTDSVVVI | ATTSIALVIG | VLVLLWRRSS DRSREVKQLA | 60 |
| VPKPVTIVEE | EDEFEVASGK | TRVSIFYGTQ | TGTAEGFAKA | LAEEIKARYE KAAVKVIDLD | 120 |
| DYTAEDDKYG | EKLKKETMAF | FMLATYGDGE | PTDNAARFYK | WFTEGTDRGV WLEHLRYGVF | 180 |
| GLGNRQYEHF | NKIAKVVDDL | LVEQGAKRLV | TVGLGDDDQC | IEDDFSAWKE ALWPELDQLL | 240 |
| QDDTNTVSTP | YTAVIPEYRV | VIHDPSVTSY | EDPYSNMANG | NASYDIHHPC RANVAVQKEL | 300 |
| HKPESDRSCI | HLEFDIFATG | LTYETGDHVG | VYADNCDDTV | EEAAKLLGQP LDLLFSIHTD | 360 |
| NNDGTSLGSS | LPPPFPGPCT | LRTALARYAD | LLNPPKKAAL | IALAAHADEP SEAERLKFLS | 420 |
| SPQGKDEYSK | WVVGSQRSLV | EVMAEFPSAK | PPLGVFFAKV | VPRLQPRYYS ISSSPRFAPH | 480 |
| RVHVTCALVY | GPTPTGRIHR | GVCSFWMKNV | VPLEKSQNCS | WAPIFIRQSN FKLPADHSVP | 540 |
| IVMVGPGTGL | APFRGFLQER | LALKEEGAQV | GPALLFFGCR | NRQMDFIYEV ELNNFVEQGA | 600 |
| LSELIVAFSR | EGPSKEYVQH | KMVEKAAYMW | NLISQGGYFY | VCGDAKGMAR DVHRTLHTIV | 660 |
| QQEEKVDSTK | AESIVKKLQM | DGRYLRDVW | | | 689 |

SEQ ID NO: 89

| | | | | |
|---|---|---|---|---|
| atgacttctg | cactttatgc | ctccgatctt | tcaaacaat | tgaaaagtat catgggaacg | 60 |
| gattctttgt | ccgatgatgt | tgtattagtt | attgctacaa | cttctctggc actggttgct | 120 |
| ggtttcgttg | tcttattgtg | gaaaaagacc | acggcagatc | gttccggcga gctaaagcca | 180 |
| ctaatgatcc | ctaagtctct | gatggcgaaa | gatgaggatg | atgacttaga tctaggttct | 240 |
| ggaaaaacga | gagtctctat | cttcttcggc | acacaaaccg | gaacagccga aggattcgct | 300 |
| aaagcacttt | cagaagagat | caaagcaaga | tacgaaaagg | cggctgtaaa agtaatcgat | 360 |
| ttggatgatt | acgctgccga | tgatgaccaa | tatgaggaaa | agttgaaaaa ggaaacattg | 420 |
| gctttctttt | gtgtagccac | gtatggtgat | ggtgaaccaa | ccgataacgc cgcaagattc | 480 |
| tacaagtggt | ttactgaaga | gaacgaaaga | gatatcaagt | tgcagcaact tgcttacggc | 540 |
| gtttttgcct | taggtaacag | acaatacgag | cactttaaca | agataggtat tgtcttagat | 600 |
| gaagagttat | gcaaaaaggg | tgcgaagaga | ttgattgaag | tcggtttagg agatgatgat | 660 |
| caatctatcg | aggatgactt | taatgcatgg | aaggaatctt | tgtggtctga attagataag | 720 |
| ttacttaagg | acgaagatga | taaatccgtt | gccactccat | cacagccgt cattccagaa | 780 |
| tatagagtag | ttactcatga | tccaagattc | acaacacaga | atcaatgga aagtaatgtg | 840 |
| gctaatggta | atactaccat | cgatattcat | catccatgta | gagtagacgt tgcagttcaa | 900 |
| aaggaattgc | acactcatga | atcagacaga | tcttgcatac | atcttgaatt tgatatatca | 960 |
| cgtactggta | tcacttacga | aacaggtgat | cacgtgggtg | tctacgctga aaaccatgtt | 1020 |
| gaaattgtag | aggaagctgg | aaagttgttg | gccatagtt | tagatcttgt tttctcaatt | 1080 |
| catgccgata | aagaggatgg | ctcaccacta | gaaagtgcag | tgcctccacc atttccagga | 1140 |
| ccatgcaccc | taggtaccgg | tttagctcgt | tacgcggatc | tgttaaatcc tccacgtaaa | 1200 |
| tcagctctag | tggccttggc | tgcgtacgcc | acagaacctt | ctgaggcaga aaaactgaaa | 1260 |
| catctaactt | caccagatgg | taaggatgaa | tactcacaat | ggatagtagc tagtcaacgt | 1320 |
| tctttactag | aagttatggc | tgctttccca | tccgctaaac | ctcctttggg tgttttcttc | 1380 |
| gccgcaatag | cgcctagact | gcaaccaaga | tactattcaa | tttcatcctc acctagactg | 1440 |
| gcaccatcaa | gagttcatgt | cacatccgct | ttagtgtacg | gtccaactcc tactggtaga | 1500 |
| atccataagg | gcgtttgttc | aacatggatg | aaaaacgcgg | ttccagcaga gaagtctcac | 1560 |
| gaatgttctg | tgctccaat | ctttatcaga | gcctccaact | tcaaactgcc ttccaatcct | 1620 |
| tctactccta | ttgtcatggt | cggtcctggt | acaggtcttg | ctccattcag aggtttctta | 1680 |
| caagagagaa | tggcctaaaa | ggaggatggt | gaagagtggg | atcttctttt gttgttttc | 1740 |
| ggctgtagaa | acagacaaat | ggatttcatc | tacgaagtgg | aactgaataa ctttgtagat | 1800 |
| caaggagtta | tttcagagtt | gataatggct | ttttctagag | aaggtgctca gaaggagtac | 1860 |
| gtccaacaca | aaatgatgga | aaaggccgca | caagtttggg | acttaatcaa agaggaaggc | 1920 |
| tatctatatg | tctgtggtga | tgcaaagggt | atggcaagag | atgttcacag aacacttcat | 1980 |
| actatagtcc | aggaacagga | aggcgttagt | tcttctgaag | cggaagcaat tgtgaaaaag | 2040 |
| ttacaaacag | agggaagata | cttgagagat | gtgtggtaa | | 2079 |

TABLE 10-continued

Sequences disclosed herein.

SEQ ID NO: 90

| | | | | | |
|---|---|---|---|---|---|
| MTSALYASDL | FKQLKSIMGT | DSLSDDVVLV | IATTSLALVA | GFVVLLWKKT | TADRSGELKP | 60
| LMIPKSLMAK | DEDDDLDLGS | GKTRVSIFFG | TQTGTAEGFA | KALSEEIKAR | YEKAAVKVID | 120
| LDDYAADDDQ | YEEKLKKETL | AFFCVATYGD | GEPTDNAARF | YKWFTEENER | DIKLQQLAYG | 180
| VFALGNRQYE | HFNKIGIVLD | EELCKKGAKR | LIEVGLGDDD | QSIEDDFNAW | KESLWSELDK | 240
| LLKDEDDKSV | ATPYTAVIPE | YRVVTHDPRF | TTQKSMESNV | ANGNTTIDIH | HPCRVDVAVQ | 300
| KELHTHESDR | SCIHLEFDIS | RTGITYETGD | HVGVYAENHV | EIVEEAGKLL | GHSLDLVFSI | 360
| HADKEDGSPL | ESAVPPPFPG | PCTLGTGLAR | YADLLNPPRK | SALVALAAYA | TEPSEAEKLK | 420
| HLTSPDGKDE | YSQWIVASQR | SLLEVMAAFP | SAKPPLGVFF | AAIAPRLQPR | YYSISSSPRL | 480
| APSRVHVTSA | LVYGPTPTGR | IHKGVCSTWM | KNAVPAEKSH | ECSGAPIFIR | ASNFKLPSNP | 540
| STPIVMVGPG | TGLAPFRGFL | QERMALKEDG | EELGSSLLFF | GCRNRQMDFI | YEDELNNFVD | 600
| QGVISELIMA | FSREGAQKEY | VQHKMMEKAA | QVWDLIKEEG | YLYVCGDAKG | MARDVHRTLH | 660
| TIVQEQEGVS | SSEAEAIVKK | LQTEGRYLRD | VW | | | 692

SEQ ID NO: 91

| | | | | | |
|---|---|---|---|---|---|
| atgtcttcct | cttcctcttc | cagtacctct | atgattgatt | tgatggctgc | tattattaaa | 60
| ggtgaaccag | ttatcgtctc | cgacccagca | aatgcctctg | cttatgaatc | agttgctgca | 120
| gaattgtctt | caatgttgat | cgaaaacaga | caattcgcca | tgatcgtaac | tacatcaatc | 180
| gctgttttga | tcggttgtat | tgtcatgttg | gtatggagaa | gatccggtag | tggtaattct | 240
| aaaagagtcg | aacctttgaa | accattagta | attaagccaa | gagaagaaga | aatagatgac | 300
| ggtagaaaga | aagttacaat | attttcggt | acccaaactg | gtacagctga | aggttttgca | 360
| aaagccttag | gtgaagaagc | taaggcaaga | tacgaaaaga | ctagattcaa | gatagtcgat | 420
| ttggatgact | atgccgctga | tgacgatgaa | tacgaagaaa | agttgaagaa | agaagatgtt | 480
| gcattttct | ttttggcaac | ctatggtgac | ggtgaaccaa | ctgacaatgc | agccagattc | 540
| tacaaatggt | ttacagaggg | taatgatcgt | ggtgaattgg | tgaaaaactt | aaagtacggt | 600
| gttttcggtt | tgggtaacag | acaatacgaa | catttcaaca | aagttgcaaa | ggttgtcgac | 660
| gatattttgg | tcgaacaagg | tgctcaaaga | ttagtccaag | taggtttggg | tgacgatgac | 720
| caatgtatag | aagatgactt | tactgcctgg | agagaagctt | tgtggcctga | attagacaca | 780
| atcttgagag | aagaaggtga | caccgccgtt | gctaccccat | atactgctgc | agtattagaa | 840
| tacagagttt | ccatccatga | tagtgaagac | gcaaagttta | atgatatcac | tttggccaat | 900
| ggtaacggtt | atacagtttt | cgatgcacaa | caccttaca | aagctaacgt | tgcagtcaag | 960
| agagaattac | atacaccaga | atccgacaga | agttgtatac | acttggaatt | tgatatcgct | 1020
| ggttccggtt | taaccatgaa | gttgggtgac | catgtaggtg | ttttatgcga | caatttgtct | 1080
| gaaactgttg | atgaagcatt | gagattgttg | gatatgtccc | ctgacactta | ttttagtttg | 1140
| cacgctgaaa | aagaagatgg | tacaccaatt | tccagttctt | taccacctcc | attccctcca | 1200
| tgtaacttaa | gaacagcctt | gaccagatac | gcttgcttgt | tatcatcccc | taaaaagtcc | 1260
| gccttggttg | ctttagccgc | tcatgctagt | gatcctactg | aagcagaaag | attgaaacac | 1320
| ttagcatctc | cagccggtaa | agatgaatat | tcaaagtgga | ttgtgaatc | tcaaagatca | 1380
| ttgttagaag | ttatggcaga | atttccatct | gccaagcctc | cattaggtgt | cttctttgct | 1440
| ggtgtagcac | ctagattgca | accaagattc | tactcaatca | gttcttcacc | taagatcgct | 1500
| gaaactagaa | ttcatgttac | atgtgcatta | gtctacgaaa | agatgccaac | cggtagaatt | 1560
| cacaagggtg | tatgctctac | ttggatgaaa | aatgctgttc | cttacgaaaa | atcagaaaag | 1620
| ttgttcttag | gtagaccaat | cttcgtaaga | caatcaaact | tcaagttgcc | ttctgattca | 1680
| aaggttccaa | taatcatgat | aggtcctggt | acaggtttag | ccccattcag | aggtttcttg | 1740
| caagaaagat | tggctttagt | tgaatctggt | gtcgaattag | gtccttcagt | tttgttcttt | 1800
| ggttgtagaa | acagaagaat | ggatttcatc | tatgaagaag | aattgcaaag | attcgtcgaa | 1860
| tctggtgcat | tggccgaatt | atctgtagct | ttttcaagag | aaggtccaac | taaggaatac | 1920
| gttcaacata | agatgatgga | taaggcatcc | gacatatgga | acatgatcag | tcaaggtgct | 1980
| tatttgtacg | tttgcggtga | cgcaaagggt | atggccagag | atgtccatag | atctttgcac | 2040
| acaattgctc | aagaacaagg | ttccatggat | agtaccaaag | ctgaaggttt | cgtaaagaac | 2100
| ttacaaactt | ccggtagata | cttgagagat | gtctggtga | | | 2139

SEQ ID NO: 92

| | | | | | |
|---|---|---|---|---|---|
| MSSSSSSSTS | MIDLMAAIIK | GEPVIVSDPA | NASAYESVAA | ELSSMLIENR | QFAMIVTTSI | 60
| AVLIGCIVML | VWRRSGSGNS | KRVEPLKPLV | IKPREEEIDD | GRKKVTIFFG | TQTGTAEGFA | 120
| KALGEEAKAR | YEKTRFKIVD | LDDYAADDDE | YEEKLKKEDV | AFFFLATYGD | GEPTDNAARF | 180
| YKWFTEGNDR | GEWLKNLKYG | VFGLGNRQYE | HFNKVAKVVD | DILVEQGAQR | LVQVGLGDDD | 240
| QCIEDDFTAW | REALWPELDT | ILREEGDTAV | ATPYTAAVLE | YRVSIHDSED | AKFNDITLAN | 300
| GNGYTVFDAQ | HPYKANVAVK | RELHTPESDR | SCIHLEFDIA | GSGLTMKLGD | HVGVLCDNLS | 360
| ETVDEALRLL | DMSPDTYFSL | HAEKEDGTPI | SSSLPPPFPP | CNLRTALTRY | ACLLSSPKKS | 420
| ALVALAAHAS | DPTEAERLKH | LASPAGKDEY | SKWVVESQRS | LLEVMAEFPS | AKPPLGVFFA | 480
| GVAPRLQPRF | YSISSSPKIA | ETRIHVTCAL | VYEKMPTGRI | HKGVCSTWMK | NAVPYEKSEK | 540
| LFLGRPIFVR | QSNFKLPSDS | KVPIIMIGPG | TGLAPFRGFL | QERLALVESG | VELGPSVLFF | 600
| GCRNRRMDFI | YEEELQRFVE | SGALAELSVA | FSREGPTKEY | VQHKMMDKAS | DIWNMISQGA | 660
| YLYVCGDAKG | MARDVHRSLH | TIAQEQGSMD | STKAEGFVKN | LQTSGRYLRD | VW | 712

SEQ ID NO: 93

| | | | | | |
|---|---|---|---|---|---|
| atggaagcct | cttacctata | catttctatt | ttgcttttac | tggcatcata | cctgttcacc | 60
| actcaactta | gaaggaagag | cgctaatcta | ccaccaaccg | tgtttccatc | aataccaatc | 120
| attgacactt | tatacttact | caaaaagcct | ctttataaga | cttttagcaaa | aattgccgct | 180
| aagtacggac | caatactgca | attacaactc | ggctacagac | gtgttctggt | gatttcctca | 240
| ccatcagcag | cagaagagtg | ctttaccaat | aacgatgaa | tcttcgcaaa | tagacctaag | 300
| acattgtttg | gcaaaatagt | gggtggaaca | tcccttggca | gtttatccta | cggcgatcaa | 360
| tggcgtaatc | taaggagagt | agcttctatc | gaaatctat | cagttcatag | gttgaacgaa | 420

TABLE 10-continued

Sequences disclosed herein.

```
tttcatgata tcagagtgga tgagaacaga ttgttaatta gaaaacttag aagttcatct    480
tctcctgtta ctcttataac agtctttat gctctaacat tgaacgtcat tatgagaatg     540
atctctggca aaagatattt cgacagtggg gatagagaat tggaggagga aggtaagaga    600
tttcgagaaa tcttagacga aacgttgctt ctagccggtg cttctaatgt tggcgactac    660
ttaccaatat tgaactggtt gggagttaag tctcttgaaa agaaattgat cgctttgcag    720
aaaaagagag atgactttt ccaggggttg attgaacagg ttagaaaatc tcgtggtgct     780
aaagtaggca aaggtagaaa aacgatgatc gaactcttat tatctttgca agagtcagaa    840
cctgagtact atacagatgc tatgataaga tcttttgtcc taggtctgct ggctgcaggt    900
agtgatactt cagcgggcac tatggaatgg gccatgagct tactggtcaa tcacccacat    960
gtattgaaga aagctcaagc tgaaatcgat agagttatcg gtaataacag attgattgac   1020
gagtcagaca ttggaaatat cccttacatc gggtgtatta tcaatgaaac tctaagactc   1080
tatccagcag ggccattgtt gttcccacat gaaagttctg ccgactgcgt tatttccggt   1140
tacaatatac ctagaggtac aatgttaatc gtaaaccaat gggcgattca tcacgatcct   1200
aaagtctggg atgatcctga aacctttaaa cctgaaagat ttcaaggatt agaaggaact   1260
agagatggtt tcaaacttat gccattcggt tctgggagaa gaggatgtcc aggtgaaggt   1320
ttggcaataa ggctgttagg gatgacacta ggctcagtga tccaatgttt tgattgggag   1380
agagtaggag atgagatggt tgacatgaca aaggtttgg gtgtcacact tcctaaggcc     1440
gttccattag ttgccaaatg taagccacgt tccgaaatga ctaatctcct atccgaactt   1500
taa                                                                  1503
```

SEQ ID NO: 94

```
MEASYLYISI LLLLASYLFT TQLRRKSANL PPTVFPSIPI IGHLYLLKKP LYRTLAKIAA     60
KYGPILQLQL GYRRVLVISS PSAAEEECFTN NDVIFANRPK TLFGKIVGGT SLGSLSYGDQ   120
WRNLRRVASI EILSVHRLNE FHDIRVDENR LLIRKLRSSS SPVTLITVFY ALTLNVIMRM   180
ISGKRYFDSG DRELEEEGKR FREILDETLL LAGASNVGDY LPILNWLGVK SLEKKLIALQ   240
KKRDDFFQGL IEQVRKSRGA KVGKGRKTMI ELLLSLQESE PEYYTDAMIR SFVLGLLAAG   300
SDTSAGTMEW AMSLLVNHPH VLKKAQAEID RVIGNNRLID ESDIGNIPYI GCIINETLRL   360
YPAGPLLFPH ESSADCVISG YNIPRGTMLI VNQWAIHHDP KVWDDPETFK PERFQGLEGT   420
RDGFKLMPFG SGRRGCPGEG LAIRLLGMTL GSVIQCFDWE RVGDEMVDMT EGLGVTLPKA   480
VPLVAKCKPR SEMTNLLSEL                                                500
```

SEQ ID NO: 95

```
atggaagtaa cagtagctag tagtgtagcc ctgagcctgg tctttattag catagtagta     60
agatgggcat ggagtgtggt gaattgggtg tggtttaagc cgaagaagct ggaaagattt    120
ttgagggagc aaggccttaa aggcaattcc tacaggtttt tatatggaga catgaaggag    180
aactctatcc tgctcaaaca agcaagatcc aaacccatga acctctccac ctcccatgac    240
atagcacctc aagtcaccc ttttgtcgac caaaccgtga aagcttacgg taagaactct     300
tttaattggg ttggcccat atccaagggtg aacataatga atccagaaga tttgaaggac    360
gtcttaacaa aaaatgttga ctttgttaag ccaatatcaa acccacttat caagttgcta    420
gctacaggta ttgcaatcta tgaaggtgag aatggaacta acacagaag gattatcaac    480
ccaacattcc attcggagag gctaaagcgt atgttacctt catttcacca aagttgtaat    540
gagatggtca aggaatggga gagcttggtg tcaaaagagg gttcatcatg tgagttggat    600
gtctggcctt tccttgaaaa tatgtcggca gatgtgatct cgagaacagc atttggaact    660
agctacaaaa aaggacagaa aatctttgaa ctcttgagag agcaagtaat atatgtaacg    720
aaaggctttc aaagtttta cattccagga tggaggttc tcccaactaa gatgaacaag     780
aggatgaatg agattaacga agaaataaaa ggattaatca gggtattaaa attgacagag    840
gagcaaatca ttaaggcagg tgaagaaacc aacgatgact tattaggtgc acttatggag    900
tcaaacttga aggacattcg ggaacatggg aaaacaaca aaaatgttgg gatgagtatt     960
gaagatgtaa ttcaggagtg taagctgtttt tactttgctg gcaagaaaac cacttcagtg   1020
ttgctggctt ggacaatggt tttacttggt caaaatcaga actggcaaga tcgagcaaga   1080
caagaggttt tgcaagtctt tggaagcagc aagccagatt ttgatggtct agctcacctt   1140
aaagtcgtaa ccatgatttt gcttgaagtt cttcgattat acccaccagt cattgaactt   1200
attcgaacca ttcacaagaa aacacaactt gggaagctct cactaccaga aggagttgaa   1260
gtccgcttac caacactgct cattcaccat gacaaggaac tgtggggtga tgatgcaaac   1320
cagttcaatc cagagaggtt tcggaagga gtttccaaga caacaaagaa ccgactctca   1380
ttcttcccct tcggagccgg tccacgcatt tgcattggac agaacttttc tatgatgaa   1440
gcaaagttgg ccttagcatt gatcttgaa cacttcacct ttgagctttc tccatctcat   1500
gcacatgctc cttcccatcg tataacccctt caaccacagt atggtgttcg tatcatttta   1560
catcgacgtt ag                                                        1572
```

SEQ ID NO: 96

```
atggaagtca ctgtcgcctc ttctgtcgct ttatccttag tcttcatttc cattgtcgtc     60
agatgggctt ggtccgttgt caactgggtt tggttcaaac caaagaagtt ggaaagattc    120
ttgagagagc aaggtttgaa gggtaattct tatagattct tgtacggtga catgaaggaa    180
aattctattt tgttgaagca agccagatcc aaaccaatga acttgtctac ctctcatgat    240
attgctccac aagttactcc attcgtcgat caaactgtta agcctacgg taagaactct     300
ttcaattggg ttggtccaat tcctagagtt aacatcatga acccagaaga tttgaaggat    360
gtcttgacca gaacgttga cttcgttaag ccaatttcca acccattgat taaattgttg    420
gctactggta ttgccattta cgaaggtgaa agtggacta agcatagaag aatcatcaac    480
cctaccttcc actctgaaag attgaagaga atgttaccat ctttccatca atcctgtaat   540
gaaatggtta aggaatggga atccttgtt tctaaagaag ttcttcttg cgaattggat     600
gtttggccat tcttggaaaa tatgtctgct gatgtcattt ccagaaccgc tttcggtacc    660
tcctacaaga agggtcaaaa gattttcgaa ttgttgagag agcaagttat ttacgttacc    720
aagggtttcc aatccttcta catcccaggt tggagattc tgccaactaa aatgaacaag    780
cgtatgaacg agatcaacga agaaattaaa ggtttgatca gaggttattat tatcgacaga    840
```

TABLE 10-continued

Sequences disclosed herein.

```
gaacaaatta ttaaagctgg tgaagaaacc aacgatgatt tgttgggtgc tttgatggag    900
tccaacttga aggatattag agaacatggt aagaacaaca agaatgttgg tatgtctatt    960
gaagatgtta ttcaagaatg taagttattc tacttcgctg gtcaagagac cacttctgtt   1020
ttgttagcct ggactatggt cttgttaggt caaaaccaaa attggcaaga tagagctaga   1080
caagaagttt tgcaagtctt cggttcttcc aagccagact ttgatggttt ggcccacttg   1140
aaggttgtta ctatgatttt gttagaagtt ttgagattgt acccaccagt cattgagtta   1200
atcagaacca ttcataaaaa gactcaattg ggtaaattat ctttgccaga aggtgttgaa   1260
gtcagattac caaccttgtt gattcaccac gataaggaat tatggggtga cgacgctaat   1320
caatttaatc cagaaagatt ttccgaaggt gtttccaagg ctaccaaaaa ccgtttgtcc   1380
ttcttcccat ttggtgctgg tccacgtatt tgtatcggtc aaaacttttc catgatggaa   1440
gccaagttgg ctttggcttt aatcttgcaa cacttcactt tcgaattgtc tccatcccat   1500
gcccacgctc cttctcatag aatcacttta caaccacaat acggtgtcag aatcatctta   1560
cacagaagat aa                                                       1572
```

SEQ ID NO: 97

```
MEVTVASSVA LSLVFISIVV RWAWSVVNWV WFKPKKLERF LREQGLKGNS YRFLYGDMKE     60
NSILLKQARS KPMNLSTSHD IAPQVTPFVD QTVKAYGKNS FNWVGPIPRV NIMNPEDLKD    120
VLTKNVDFVK PISNPLIKLL ATGIAIYEGE KWTKHRRIIN PTFHSERLKR MLPSFHQSCN    180
EMVKEWESLV SKEGSSCELD VWPFLENMSA DVISRTAFGT SYKKGQKIFE LLREQVIYVT    240
KGFQSFYIPG WRFLPTKMNK RMNEINEEIK GLIRGIIIDR EQIIKAGEET NDDLLGALME    300
SNLKDIREHG KNNKNVGMSI EDVIQECKLF YFAGQETTSV LLAWTMVLLG QNQNWQDRAR    360
QEVLQVFGSS KPDFDGLAHL KVVTMILLEV LRLYPPVIEL IRTIHKKTQL GKLSLPEGVE    420
VRLPTLLIHH DKELWGDDAN QFNPERFSEG VSKATKNRLS FFPFGAGPRI CIGQNFSMME    480
AKLALALILQ HFTFELSPSH AHAPSHRITL QPQYGVRIIL HRR                      523
```

SEQ ID NO: 98

```
atggaagcat caagggctag ttgtgttgcg ctatgtgttg tttgggtgag catagtaatt     60
acattggcat ggagggtgct gaattgggtg tggttgaggc caagaaaact agaaagatgc    120
ttgagggagc aaggccttac aggcaattct tacaggcttt gtttggaga caccaaggat    180
ctctcgaaga tgctggaaca aacacaatcc aaacccatca aactctccac ttcccatgat    240
atagcgccac gagtcacccc attttttcct cgaactctga actctaatgg caagaattct    300
tttgtttgga tgggccctat accaagagtg cacatcatga atccagaaga tttgaaagat    360
gccttcaaca gacatgatga ttttcataag acagtaaaaa atcctatcat gaagtctcca    420
ccaccgggca ttgtaggcat tgaaggtgag caatgggcta aacacagaaa gattatcaac    480
ccagcattcc atttagagaa gctaaagggt atggtaccaa tattttacca aagttgtagc    540
gagatgatta caaatgggag gagctgtgtg tccaaagaga gttcatgtga gttggatgtg    600
tggccttatc ttgaaaattt taccagcgat gtgatttccc gagctgcatt tggaagtagc    660
tatgaagagg gaaggaaaat attttcaacta ctaagagagg agcaaaagt ttattcggta    720
gctctacgaa gtgtttacat tccaggatgg aggtttctac caaccaagca gaacaagaag    780
acgaaggaaa ttcacaatga aattaaaggc ttacttaagg gcattataaa taaagggaa    840
gaggcgatga aggcaggga agccactaaa gatgacttac taggaatact tatggagtcc    900
aacttcaggg aaattcagga acatgggaac aacaaaaatg ctggaatgag tattgaagat    960
gtaattggag agtgtaagtt gtttttacttt gctgggcaag agaccacttc ggtgttgctt   1020
gtttggacaa tgattttact aagccaaaat caggattggc aagctcgtgc aagagaagag   1080
gtcttgaaag tctttggaag caacatccca acctatgaag agctaagtca cctaaaagtt   1140
gtgaccatga ttttacttga agttcttcga ttatacccat cagtcgttgc gcttcctcga   1200
accactcaca agaaaacaca gcttggaaaa ttatcattac cagctggagt ggaagtctcc   1260
ttgcccatac tgcttgttca ccatgacaaa gagttgtggg gtgaggatgc aaatgagttc   1320
aagccagaga ggttttcaga gggagtttca aaggcaacaa gaacaaatt tacatactta   1380
cctttcggag ggggtccaag gatttgcatt ggacaaaact ttgccatggt ggaagctaaa   1440
ttggccttgg ccctgatttt acaacacttt gcctttgagc tttctccatc ctatgctcat   1500
gctccttctg cagttataac ccttcaacct caatttggtg ctcatatcat tttgcataaa   1560
cgttga                                                              1566
```

SEQ ID NO: 99

```
atggaagctt ctagagcatc ttgtgttgct ttgtgtgttg tttgggtttc catcgttatt     60
actttggctt ggagagtttt gaattgggtc tggttaagac caaaaaagtt ggaaagatgc    120
ttgagagaac aaggtttgac tggtaactct tacagattgt tgttcggtga taccaaggac    180
ttgtctaaga tgttggaaca aactcaatcc aagcctatca agttgtctac ctctcatgat    240
attgctccaa gagttactcc attcttccat agaactgtta actccaacgg taagaactct    300
tttgtttgga tgggtccaat tccaagagtc catattatga accctgaaga tttgaaggac    360
gctttcaaca gacatgatga tttccataag accgtcaaa acccaattat gaagtctcca    420
ccaccaggta tagttggtat tgaaggtgaa caatgggcca aacatagaaa gattattaac    480
ccagccttcc acttggaaaa gttgaaaggt atggttccaa tcttctacca atcctgctct    540
gaaatgatta caagtgggga atccttggtt tccaaagaat cttcctgtga attggatgtc    600
tggccatatt tggaaaactt cacctccgat gttatttcca gctgctttt tggttcttct    660
tacgaagaag gtagaaagat cttccaatta ttgagagaag aagccaaggt ttactccgtt    720
gctttgagat ctgtttacat tccaggttgg agattcttgc caactaagca aaacaaaaag    780
accaagaaa tccacaacga aatcaagggt ttgttgaagg gtatcatcaa caagagagaa    840
gaagctatga agctggtga agctacaaaa gatgatttgt tgggtatctt gatggaatcc    900
aacttcagag aaattcaaga acacggtaac aacaagaatg ccggtatgtc tattgaagat    960
gttatcggtg aatgcaagtt gttctacttt gctggtcaag aaactacctc cgttttgttg   1020
gtttggacca tgattttgtt gtcccaaaat caagattggc aagctagagc tagaagaa   1080
gtcttgaaag ttttcggttc taacatccca acctacgaag aattgtctca cttgaaggtt   1140
gtcactatga tcttgttgga agtattgaga ttatacccat ccgttgttgc attgccaaga   1200
```

TABLE 10-continued

Sequences disclosed herein.

```
actactcata agaaaactca attgggtaaa ttgtccttgc cagctggtgt tgaagtttct   1260
ttgccaattt tgttagtcca ccacgacaaa gaattgtggg gtgaagatgc taatgaattc   1320
aagccagaaa gattctccga aggtgtttct aaagctacca agaacaagtt cacttacttg   1380
ccatttggtg gtggtccaag aatatgtatt ggtcaaaatt tcgctatggt cgaagctaaa   1440
ttggctttgg ctttgatctt gcaacatttc gctttcgaat tgtccaccat ctatgctcat   1500
gctccatctg ctgttattac attgcaacca caatttggtg cccatatcat cttgcataag   1560
agataac                                                              1567
```

SEQ ID NO: 100

```
MEASRASCVA LCVVWVSIVI TLAWRVLNWV WLRPKKLERC LREQGLTGNS YRLLFGDTKD    60
LSKMLEQTQS KPIKLSTSHD IAPRVTPFFH RTVNSNGKNS FVWMGPIPRV HIMNPEDLKD   120
AFNRHDDFHK TVKNPIMKSP PPGIVGIEGE QWAKHRKIIN PAFHLEKLKG MVPIFYQSCS   180
EMINKWESLV SKESSCELDV WPYLENFTSD VISRAAFGSS YEEGRKIFQL LREEAKVYSV   240
ALRSVYIPGW RFLPTKQNKK TKEIHNEIKG LLKGIINKRE EAMKAGEATK DDLLGILMES   300
NFREIQEHGN NKNAGMSIED VIGECKLFYF AGQETTSVLL VWTMILLSQN QDWQARAREE   360
VLKVFGSNIP TYEELSHLKV VTMILLEVLR LYPSVVALPR TTHKKTQLGK LSLPAGVEVS   420
LPILLVHHDK ELWGEDANEF KPERFSEGVS KATKNKFTYL PFGGGPRICI GQNFAMVEAK   480
LALALILQHF AFELSPSYAH APSAVITLQP QFGAHIILHK R                       521
```

SEQ ID NO: 101

```
ASWVAVLSVV WVSMVIAWAW RVLNWVWLRP KKLEKCLREQ GLAGNSYRLL FGDTKDLSKM    60
LEQTQSKPIK LSTSHDIAPH VTPFFHQTVN SYGKNSFVWM GPIPRVHIMN PEDLKDTFNR   120
HDDFHKVVKN PIMKSLPQGI VGIEGEQWAK HRKIINPAFH LEKLKGMVPI FYRSCSEMIN   180
KWESLVSKES SCELDVWPYL ENFTSDVISR AAFGSSYEEG RKIFQLLREE AKIYTVAMRS   240
VYIPGWRFLP TKQNKKAKEI HNEIKGLLKG IINKREEAMK AGEATKDDLL GILMESNFRE   300
IQEHGNNKNA GMSIEDVIGE CKLFYFAGQE TTSVLLVWTM VLLSQNQDWQ ARAREEVLQV   360
FGSNIPTYEE LSQLKVVTMI LLEVLRLYPS VVALPRTTHK KTQLGKLSLP AGVEVSLPIL   420
LVHHDKELWG EDANEFKPER FSEGVSKATK NQFTYFPFGG GPRICIGQNF AMMEAKLALS   480
LILRHFALEL SPLYAHAPSV TITLQPQYGA HIILHKR                            517
```

SEQ ID NO: 102

```
MEASRPSCVA LSVVLVSIVI AWAWRVLNWV WLRPNKLERC LREQGLTGNS YRLLFGDTKE    60
ISMMVEQAQS KPIKLSTTHD IAPRVIPFSH QIVYTYGRNS FVWMGPTPRV TIMNPEDLKD   120
AFNKSDEFQR AISNPIVKSI SQGLSSLEGE KWAKHRKIIN PAFHLEKLKG MLPTFYQSCS   180
EMINKWESLV FKEGSREMDV WPYLENLTSD VISRAAFGSS YEEGRKIFQL LREEAKFYTI   240
AARSVYIPGW RFLPTKQNKR MKEIHKEVRG LLKGIINKRE DAIKAGEEAK GNLLGILMES   300
NFREIQEHGN NKNAGMSIED VIGECKLFYF AGQETTSVLL VWTLVLLSQN QDWQARAREE   360
VLQVFGTNIP TYDQLSHLKV VTMILLEVLR LYPAVVELPR TTYKKTQLGK FLLPAGVEVS   420
LHIMLAHHDK ELWGEDAKEF KPERFSEGVS KATKNQFTYF PFGAGPRICI GQNFAMLEAK   480
LALSLILQHF TFELSPSYAH APSVTITLHP QFGAHFILHK R                       521
```

SEQ ID NO: 103

```
CVALSVVLVS IVIAWAWRVL NWVWLRPNKL ERCLREQGLT GNSYRLLFGD TKEISMMVEQ    60
AQSKPIKLST THDIAPRVIP FSHQIVYTYG RNSFVWMGPT PRVTIMNPED LKDAFNKSDE   120
FQRAISNPIV KSISQGLSSL EGEKWAKHRK IINPAFHLEK LKGMLPTFYQ SCSEMINKWE   180
SLVFKEGSRE MDVWPYLENL TSDVISRAAF GSSYEEGRKI FQLLREEAKF YTIAARSVYI   240
PGWRFLPTKQ NKRMKEIHKE VRGLLKGIIN KREDAIKAGE AAKGNLLGIL MESNFREIQE   300
HGNNKNAGMS IEDVIGECKL FYFAGQETTS VLLVWTLVLL SQNQDWQARA REEVLQVFGT   360
NIPTYDQLSH LKVVTMILLE VLRLYPAVVE LPRTTYKKTQ LGKFLLPAGV EVSLHIMLAH   420
HDKELWGEDA KEFKPERFSE GVSKATKNQF TYFPFGAGPR ICIGQNFAML EAKLALSLIL   480
QHFTFELSPS YAHAPSVTIT LHPQFGAHFI LHKR                               514
```

SEQ ID NO: 104

```
MGPIPRVHIM NPEDLKDTFN RHDDFHKVVK NPIMKSLPQG IVGIEGDQWA KHRKIINPAF    60
HLEKLKGMVP IFYQSCSEMI NIWKSLVSKE SSCELDVWPY LENFTSDVIS RAAFGSSYEE   120
GRKIFQLLRE EAKVYTVAVR SVYIPGWRFL PTKQNKKTKE IHNEIKGLLK IINKREEAM   180
KAGEATKDDL LGILMESNFR EIQEHGNNKN AGMSIEDVIG ECKLFYFAGQ ETTSVLLVWT   240
MVLLSQNQDW QARAREEVLQ VFGSNIPTYE ELSHLKVVTM ILLEVLRLYP SVVALPRTTH   300
KKTQLGKLSL PAGVEVSLPI LLVHHDKELW GEDANEFKPE RFSEGVSKAT KNQFTYFPFG   360
GGPRICIGQN FAMMEAKLAL SLILQHFTFE LSPQYSHAPS VTITLQPQYG AHLILHKR    418
```

SEQ ID NO: 105

```
atgggtttgt tcccattaga ggattcctac gcgctggtct ttgaaggact agcaataaca     60
ctggctttgt actatctact gtctttcatc tacaaaacat ctaaaaagac atgtacacct    120
cctaaagcat ctggtgaaat cattccaatt acaggaatca tattgaatct gctatctggc    180
tcaagtggtc tacctattat cttagcactt gcctctttag cagacagatg tggtcctatt    240
ttcaccatta ggctgggtat taggagagtg ctagtagtat caaattgggt aatcgctaag    300
gagattttca ctacccacga tttgatagtt tctaatagac aaaatactt agccgctaag    360
attcttggtt tcaattatgt ttcattctct ttcgctccat acggcccata ttgggtcgga    420
atcagaaaga ttattgctac aaaactaatg tcttcttcca gacttcagaa gttgcaattt    480
gtaagagttt tgaactaga aaactctatg aaatctatca gagaatcatg gaggagaaa    540
aaggatgaag agggaaggt attagttgag atgaaaaagt ggttctggga actgaatatg    600
```

TABLE 10-continued

Sequences disclosed herein.

```
aacatagtgt taaggacagt tgctggtaaa caatacactg gtacagttga tgatgccgat    660
gcaaagcgta tctccgagtt attcagagaa tggtttcact acactggcag atttgtcgtt    720
ggagacgctt ttcctttttct aggttggttg gacctgggcg gatacaaaaa gacaatggaa   780
ttagttgcta gtagattgga ctcaatggtc agtaaatggt tagatgagca tcgtaaaaag    840
caagctaacg atgacaaaaa ggaggatatg gatttcatgg atatcatgat ctccatgaca    900
gaagcaaatt caccacttga aggatacggc actgatacta ttatcaagac cacatgtatg    960
actttgattg tttcaggagt tgatacaacc tcaatcgtac ttacttgggc cttatcactt   1020
ttgttaaaca acagagatac tttgaaaaag gcacaagagg aattagatat gtgcgtaggt   1080
aaaggaagac aagtcaacga gtctgatctt gttaacttga tatacttgga agcagtgctt   1140
aaagaggctt taagacttta cccagcagcg ttcttaggcg gaccaagagc attcttggaa   1200
gattgtactg ttgctggtta tagaattcca aagggcacct gcttgttgat taacatgtgg   1260
aaactgcata gagatccaaa catttggagt gatccttgcg aattcaagcc agaaagattt   1320
ttgacaccta atcaaaagga tgttgatgtg atcggtatgg atttcgaatt gataccattt   1380
ggtgccggca aagatattg tccaggtact agattggctt tacagatgtt gcatatcgta   1440
ttagcgacat tgctgcaaaa cttcgaaatg tcaacaccaa acgatgcgcc agtcgatatg   1500
actgcttctg ttggcatgac aaatgccaaa gcatcacctt tagaagtctt gctatcacct   1560
cgtgttaaat ggtcctaa                                                  1578
```

SEQ ID NO: 106

```
MGLFPLEDSY ALVFEGLAIT LALYYLLSFI YKTSKKTCTP PKASGEHPIT GHLNLLSGSS     60
GLPHLALASL ADRCGPIFTI RLGIRRVLVV SNWEIAKEIF TTHDLIVSNR PKYLAAKILG    120
FNYVSFSFAP YGPYWVGIRK IIATKLMSSS RLQKLQFVRV FELENSMKSI RESWKEKKDE    180
EGKVLVEMKK WFWELNMNIV LRTVAGKQYT GTVDDADAKR ISELFREWFH YTGRFVVGDA    240
FPPFLGWLDLG GYKKTMELVA SRLDSMVSKW LDEHRKKQAN DDKKEDMDFM DIMISMTEAN   300
SPLEGYGTDT IIKTTCMTLI VSGVDTTSIV LTWALSLLLN NRDTLKKAQE ELDMCVGKGR    360
QVNESDLVNL IYLEAVLKEA LRLYPAAFLG GPRAFLEDCT VAGYRIPKGT CLLINMWKLH    420
RDPNIWSDPC EFKPERFLTP NQKDVDVIGM DFELIPFGAG RRYCPGTRLA LQMLHIVLAT    480
LLQNFEMSTP NDAPVDMTAS VGMTNAKASP LEVLLSPRVK WS                       522
```

SEQ ID NO: 107

```
atgatacaag ttttaactcc aattctactc ttcctcatct tcttcgtttt ctggaaagtc     60
tacaaacatc aaaagactaa aatcaatcta ccaccaggtt ccttcggctg gccattttg    120
ggtgaaacct tagccttact tagagcaggc tgggattctg agccagaaag attcgtaaga   180
gagcgtatca aaaagcatgg atctccactt gtttcagca catcactatt tggagacaga   240
ttcgctgttc tttgcggtcc agctggtaat aagtttttgt tctgcaacga aaacaaatta   300
gtggcatctt ggtggccagt ccctgtaagg aagttgttcg gtaaaagttt actcacaata   360
agaggagatg aagcaaaatg gatgagaaaa atgctattgt cttacttggg tccagatgca   420
tttgccacac attatgccgt tactatggat gttgtaacac atagacatat tgatgtccat   480
tggaggggca aggaggaagt taatgtattt caaacagtta agttgtacgc attcgaatta   540
gcttgtagat tattcatgaa cctagatgac ccaaaccaca tcgcgaaact cggtagtctt   600
ttcaacattt tcctcaaagg gatcatcgag cttcctatag acgttcctgg aactagattt   660
tactccagta aaaaggccgc agctgccatt agaattgaat tgaaaaagct cattaaagct   720
agaaaactcg aattgaagga gggtaaggcg tcttcttcac aggacttgct ttctcatcta   780
ttaacatcac ctgatgagaa tgggatgttc ttgacagaag aggaaatagt cgataacatt   840
ctactttgt tattcgctgg tcacgatacc tctgcactat caataacact tttgatgaaa   900
accttaggtg aacacagtga tgtgtacgac aaggtttga ggaacaatt agaaatttcc    960
aaaacaaagg aggcttggga atcactaaag tgggaagata tccagaagat gaagtactca  1020
tggtcagtaa tctgtgaagt catgagattg aatcctcctg tcatagggac atacagagag  1080
gcgttggttg atatcgacta tgctggttac actatcccaa aaggatggaa gttgcattgg  1140
tcagctgttt ctactcaaag agacgaagcc aatttcgaag atgtaactag attcgatcca  1200
tccagatttg aaggggcagg ccctactcca ttcacatttg tgcctttcgg tggaggtcct  1260
agaatgtgtt taggcaaaga gtttgccagg ttagaagtgt tagcatttct ccacaacatt  1320
gttaccaact ttaagtggga tcttctaatc cctgatgaga agatcgaata tgatccaatg  1380
gctactccag ctaagggctt gccaattaga cttcatccac accaagtcta a            1431
```

SEQ ID NO: 108

```
MIQVLTPILL FLIFFVFWKV YKHQKTKINL PPGSFGWPFL GETLALLRAG WDSEPERFVR     60
ERIKKHGSPL VFKTSLFGDR FAVLCGPAGN KFLFCNENKL VASWWPVPVR KLFGKSLLTI    120
RGDEAKWMRK MLLSYLGPDA FATHYAVTMD VVTRRHIDVH WRGKEEVNVF QTVKLYAFEL    180
ACRLFMNLDD PNHIAKLGSL FNIFLKGIIE LPIDVPGTRF YSSKKAAAAI RIELKKLIKA    240
RKLELKEGKA SSSQDLLSHL LTSPDENGMF LTEEEIVDNI LLLLFAGHDT SALSITLLMK    300
TLGEHSDVYD KVLKEQLEIS KTKEAWESLK WEDIQKMKYS HSVICEVMRL NPPVIGTYRE    360
ALVDIDYAGY TIPKGWKLHW SAVSTQRDEA NFEDVTRFDP SRFEGAGPTP FTFVPFGGGP    420
RMCLGKEFAR LEVLAFLHNI VTNFKWDLLI PDEKIEYDPM ATPAKGLPIR LHPHQV        476
```

SEQ ID NO: 109

```
atggagtctt tagtggttca tacagtaaat gctatctggt gtattgtaat cgtcggatt     60
ttctcagttg gttatcacgt ttacggtaga gctgtggtcg aacaatggag aatgagaaga   120
gaagc tacaaggtgt taaaggccca ccaccatcca tcttcaatgg taacgtctca   180
gaaatgcaac gtatccaatc cgaagctaaa cactgctctg gcgataacat tatctcacat   240
gattattctt cttcattatt cccacacttc gatcactgga gaaaacagta cggcagaatc   300
tacacatact ctactggatt aaagcaacac ttgtacatca atcatccaga aatggtgaag   360
gagctatctc agactaacac attgaacttg ggtagaatca cccatataac caaaagattg   420
aatcctatct taggtaacgg aatcataacc tctaatggtc ctcattgggc ccatcagcgt   480
```

TABLE 10-continued

Sequences disclosed herein.

```
agaattatcg cctacgagtt tactcatgat aagatcaagg gtatggttgg tttgatggtt    540
gagtctgcta tgcctatgtt gaataagtgg gaggagatgg taaagagagg cggagaaatg    600
ggatgcgaca taagagttga tgaggacttg aaagatgttt cagcagatgt gattgcaaaa    660
gcctgtttcg gatcctcatt ttctaaaggt aaggctattt tctctatgat aagagatttg    720
cttacagcta tcacaaagag aagtgttcta ttcagattca acggattcac tgatatggtc    780
tttgggagta aaaagcatgg tgacgttgat atagacgctt tagaaatgga attggaatca    840
tccatttggg aaactgtcaa ggaacgtgaa atagaatgta aagatactca caaaaaggat    900
ctgatgcaat tgattttgga aggggcaatg cgttcatgtg acggtaacct tgggataaaa    960
tcagcatata aagagatttgt tgtagataat tgtaaatcta tctacttcgc agggcatgat   1020
agtacagctg tctcagtgtc atggtgtttg atgttactgg ccctaaaccc atcatggcaa   1080
gttaagatcc gtgatgaaat tctgtcttct tgcaaaaatg gtattccaga tgccgaaagt   1140
atcccaaacc ttaaaacagt gactatggtt attcaagaga caatgagatt ataccctcca   1200
gcaccaatcg tcgggagaga agcctctaaa gatatcagat tgggcgatct agttgttcct   1260
aaaggcgtct gtatatggac actaatacca gctttacaca gagatcctga gatttgggga   1320
ccagatgcaa acgatttcaa accagaaaga ttttctgaag gaatttcaaa ggcttgtaag   1380
tatcctcaaa gttacattcc atttggtctg gtcctagaa catgcgttgg taaaaacttt    1440
ggcatgatgg aagtaaaggt tcttgtttcc ctgattgtct ccaagttctc tttcactcta   1500
tctcctacct accaacatag tcctagtcac aaacttttag tagaaccaca acatgggtg    1560
gtaattagag tggtttaa                                                  1578
```

SEQ ID NO: 110

```
MESLVVHTVN AIWCIVIVGI FSVGYHVYGR AVVEQWRMRR SLKLQGVKGP PPSIFNGNVS     60
EMQRIQSEAK HCSGDNIISH DYSSSLFPHF DHWRKQYGRI YTYSTGLKQH LYINHPEMVK    120
ELSQTNTLNL GRITHITKRL NPILGNGIIT SNGPHWAHQR RIIAYEFTHD KIKGMVGLMV    180
ESAMPMLNKW EEMVKRGGEM GCDIRVDEDL KDVSADVIAK ACFGSSFSKG KAIFSMIRDL    240
LTAITKRSVL FRFNGFTDMV FGSKKHGDVD IDALEMELES SIWETVKERE IECKDTHKKD    300
LMQLILEGAM RSCDGNLWDK SAYRRFVVDN CKSIYFAGHD STAVSVSWCL MLLALNPSWQ    360
VKIRDEILSS CKNGIPDAES IPNLKTVTMV IQETMRLYPP APIVGREASK DIRLGDLVVP    420
KGVCIWTLIP ALHRDPEIWG PDANDFKPER FSEGISKACK YPQSYIPFGL GPRTCVGKNF    480
GMMEVKVLVS LIVSKFSFTL SPTYQHSPSH KLLVEPQHGV VIRVV                    525
```

SEQ ID NO: 111

```
atgtacttcc tactacaata cctcaacatc acaaccgttg gtgtctttgc acattgttt     60
ctctcttatt gtttacttct ctggagaagt agagcggtta acaaaaagat tgccccagaa    120
gctgccgctg catggcctat tatcggccac ctccacttac ttgcaggtgg atcccatcaa    180
ctaccacata ttacattggg taacatggca gataagtacg gtcctgtatt cacaatcaga    240
ataggcttgc atagagctgt agttgtctca tcttgggaaa tggcaaagga atgttcaaca    300
gctaatgatc aagtgtcttc ttcaagacct gaactattag cttctaagtt gttgggttat    360
aactacgcca tgtttggttt ttcaccatac ggttcatact ggagagaaat gagaaagatc    420
atctctctcg aattactatc taattccaga ttggaactat tgaaagatgt tagagcctca    480
gaagttgtca catctattaa ggaactatac aaattgtggg cggaaaagaa gaatgagtca    540
ggattggttt ctgtcgagat gaaacaatgg ttcggagatt tgacttttaaa cgtgatcttg    600
agaatggttg ctggtaaaag atacttctcc gcgagtgacg cttcagaaaa caaacaggcc    660
cagcgttgta aagagtcttt cagagaattc ttccatctct ccggcttgtt tgtggttgct    720
gatgctatac cttttcttgg atggctcgat tggggaagac acgagaagac cttgaaaaag    780
accgccatag aaatggattc catcgcccag gagtggcttg aggaacatag acgtagaaaa    840
gattctggag atgataattc tacccaagat ttcatggacg ttatgcaatc tgtgctagat    900
ggcaaaaatc taggcggata cgatgctgat acgattaaca aggctacatg cttaactctt    960
atatcaggtg gcagtgatac tactgtagtt tctttgacat gggctcttag tcttgtgtta   1020
aacaatagag atactttgaa aaaggcacag gaagagttag acatccaagt cggtaaggaa   1080
agattggtta acgagcaaga catccagtaag ttagttttact tgcaagcaat agtaaaagag   1140
acactcagac tttatccacc aggtcctttg ggtggtttga caccattcac tgaagattgt   1200
acactaggtg gctatcacgt ttcaaaagga actagattaa tcatgaactt atccaagatt   1260
caaaaagatc cacgtatttg gtctgatcct actgaattcc aaccagagag attccttacg   1320
actcataaag atgtcgatcc acgtggtaaa cactttgaat tcattccatt cggtgcagga   1380
agacgtgcat gtcctggtat cacattcgga ttacaagtac tacatctaac attggcatct   1440
ttcttgcatg cgtttgaatt ttcaacacca tcaaatgagc aggttaacat gagagaatca   1500
ttaggtctta cgaatatgaa atctaccca ttagaagttt tgatttctcc aagactatcc   1560
cttaattgct tcaaccttat gaaaatttga                                     1590
```

SEQ ID NO: 112

```
MYFLLQYLNI TTVGVFATLF LSYCLLLWRS RAGNKKIAPE AAAAWPIIGH LHLLAGGSHQ     60
LPHITLGNMA DKYGPVFTIR IGLHRAVVVS SWEMAKECST ANDQVSSSRP ELLASKLLGY    120
NYAMFGFSPY GSYWREMRKI ISLELLSNSR LELLKDVRAS EVVTSIKELY KLWAEKKNES    180
GLVSVEMKQW FGDLTLNVIL RMVAGKRYFS ASDASENKQA QRCRRVFREF FHLSGLFVVA    240
DAIPFLGWLD WGRHEKTLKK TAIEMDSIAQ EWLEEHRRRK DSGDDNSTQD FMDVMQSVLD    300
GKNLGGYDAD TINKATCLTL ISGGSDTTVV SLTWALSLVL NNRDTLKKAQ EELDIQVGKE    360
RLVNEQDISK LVYLQAIVKE TLRLYPPGPL GGLRQFTEDC TLGGYHVSKG TRLIMNLSKI    420
QKDPRIWSDP TEFQPERFLT THKDVDPRGK HFEFIPFGAG RRACPGITFG LQVLHLTLAS    480
FLHAFEFSTP SNEQVNMRES LGLTNMKSTP LEVLISPRLS SCSLYN                   526
```

SEQ ID NO: 113

```
atggaaccta acttttactt gtcattacta ttgttgttcg tgaccttcat ttctttaagt     60
ctgttttttca tcttttacaa acaaaagtcc ccattgaatt tgccaccagg gaaaatgggt    120
```

TABLE 10-continued

Sequences disclosed herein.

```
tacccTatca taggtgaaag tttagaattc ctatccacag gctggaaggg acatcctgaa    180
aagttcatat ttgatagaat gcgtaagtac agtagtgagt tattcaagac ttctattgta    240
ggcgaatcca cagttgtttg ctgtggggca gctagtaaca aattcctatt ctctaacgaa    300
aacaaactgg taactgcctg gtggccagat tctgttaaca aaatcttccc aacaacttca    360
ctggattcta atttgaagga ggaatctata aagatgagaa agttgctgcc acagttcttc    420
aaaccagaag cacttcaaag atacgtcggc gttatggatg taatcgcaca aagacatttt    480
gtcactcact gggacaacaa aaatgagatc acagtttatc cacttgctaa aagatacact    540
ttcttgcttg cgtgtagact gttcatgtct gttgaggatg aaaatcatgt ggcgaaattc    600
tcagacccat ccaactaatc cgctgcaggc atcatttcac ttcctatcga tcttcctggt    660
actccattca acaaggccat aaaggcttca aatttcatta gaaagagct gataaagatt    720
atcaaacaaa gacgtgttga tctggcagag ggtacagcat ctccaaccca ggatatctta    780
tcacatatgc tattaacatc tgatgaaaac ggtaaatcta tgaacgagtt gaacattgcc    840
gacaagattc ttggactatt gataggaggc cacgatacag cttcagtagc ttgcacattt    900
ctagtgaagt acttaggaga attaccacat atctacgata aagtctacca agagcaaatg    960
gaaattgcca agtccaaacc tgctgggaa ttgttgaata ggatgactt gaaaaagatg   1020
aagtattcat ggaatgtggc atgtgaggta atgagattgt caccaccttt acaaggtggt   1080
tttagagagg ctataactga cttttatgttt aacggtttct ctattccaaa agggtggaag   1140
ttatactggt ccgccaactc tacacacaaa aatgcagaat gtttcccaat gcctgagaaa   1200
ttcgatccta ccagatttga aggtaatggt ccagcgcctt atacattttgt accattcggt   1260
ggaggcccta gaatgtgtcc tggaaaggaa tacgctagat tagaaatctt ggttttcatg   1320
cataatctgg tcaaacgttt taagtgggaa aaggttattc cagacgaaaa gattattgtc   1380
gatccattcc caatcccagc taaagatctt ccaatccgtt tgtatcctca caaagcttaa   1440
```

SEQ ID NO: 114

```
MEPNFYLSLL LLFVTFISLS LFFIFYKQKS PLNLPPGKMG YPIIGESLEF LSTGWKGHPE     60
KFIFDRMRKY SSELFKTSIV GESTVVCCGA ASNKFLFSNE NKLVTAWWPD SVNKIFPTTS    120
LDSNLKEESI KMRKLLPQFF KPEALQRYVG VMDVIAQRHF VTHWDNKNEI TVYPLAKRYT    180
FLLACRLFMS VEDENHVAKF SDPFQLIAAG IISLPIDLPG TPFNKAIKAS NFIRKELIKI    240
IKQRRVDLAE GTASPTQDIL SHMLLTSDEN GKSMNELNIA DKILGLLIGG HDTASVACTF    300
LVKYLGELPH IYDKVYQEQM EIAKSKPAGE LLNWDDLKKM KYSWNVACEV MRLSPPLQGG    360
FREAITDFMF NGFSIPKGWK LYWSANSTHK NAECFPMPEK FDPTRFEGNG PAPYTFVPFG    420
GGPRMCPGKE YARLEILVFM HNLVKRFKWE KVIPDEKIIV DPFPIPAKDL PIRLYPHKA     479
```

SEQ ID NO: 115

```
atggcctctg ttactttggg ttcctggatc gtcgtccacc accataacca tcaccatcca     60
tcatctatcc taactaaatc tcgttcaaga tcctgtccta ttacactaac caaaccaatc    120
tcttttcgtt caaagagaac agtttcctct agtagttcta tcgtgtcctc tagtgtcgtc    180
actaaggaag acaatctgag acagtctgaa ccttcttcct ttgatttcat gtcatatatc    240
attactaagg cagaactagt gaataaggct cttgattcag cagttccatt aagagagcca    300
ttgaaaatcc atgaagcaat gagatactct cttctagctg gcgggaagag agtcagacct    360
gtactctgca tagcagcgtg cgaattagtt ggtggcgagg aatcaaccgc tatgcctgcc    420
gcttgtctg tagaaatgat tcatacaatg tcactgatac gcgatgattt gccatgtatg    480
gataacgatg atctgagaag gggtaagcca actaaccata aggttttcgg cgaagatgtt    540
gccgtcttag ctggtgatgc tttgttatct ttcgcgttcg aacatttggc atccgcaaca    600
tcaagtgatg ttgtgtcacc agtaagagta gttagagcag ttggagaact ggctaaagct    660
attggaactg aggtttagt tgcaggtcaa gtcgtcgata tctcttccga aggtcttgat    720
ttgaatgatg taggtcttga acatctcgaa ttcatccatc ttcacaagac agctgcactt    780
ttagaagcca gtgcggttct cggcgcaatt gttggcggag ggagtgatga cgaaattgag    840
agattgagga agtttgctag atgtataggg ttactgttcc aagtagtaga cgatatacta    900
gatgtgacaa agtcttccaa agagtgggga aaaacagctg gtaaagattt gattgccgac    960
aaattgacct accctaagat tatgggggcta gaaaaatcaa gagaatttgc cgagaaactc   1020
aatagagagg cgcgtgatca actgttgggt ttcgattctg ataaagttgc accactctta   1080
gccttagcca actacatcgc ttacagacaa aactaa                              1116
```

SEQ ID NO: 116

```
MASVTLGSWI VVHHHNHHHP SSILTKSRSR SCPITLTKPI SFRSKRTVSS SSSIVSSSVV     60
TKEDNLRQSE PSSFDFMSYI ITKAELVNKA LDSAVPLREP LKIHEAMRYS LLAGGKRVRP    120
VLCIAACELV GGEESTAMPA ACAVEMIHTM SLIHDDLPCM DNDDLRRGKP TNHKVFGEDV    180
AVLAGDALLS FAFEHLASAT SSDVVSPVRV VRAVGELAKA IGTEGLVAGQ VVDISSEGLD    240
LNDVGLEHLE FIHLHKTAAL LEASAVLGAI VGGGSDDEIE RLRKFARCIG LLFQVVDDIL    300
DVTKSSKELG KTAGKDLIAD KLTYPKIMGL EKSREFAEKL NREARDQLLG FDSDKVAPLL    360
ALANYIAYRQ N                                                          371
```

SEQ ID NO: 117

```
MATLLEHFQA MPFAIPIALA ALSWLFLFYI KVSFFSNKSA QAKLPPVPVV PGLPVIGNLL     60
QLKEKKPYQT FTRWAEEYGP IYSIRTGAST MVVLNTTQVA KEAMVTRYLS ISTRKLSNAL    120
KILTLDMKCMV AISDYNDFHK MIKRYILSNV LGPSAQKRHR SNRDTLRANV CSRLHSQVKN    180
SPREAVNFRR VFEWELFGIA LKQAFGKDIE KPIYVEELGT TLSRDEIFKV LVLDIMEGAI    240
EVDWRDFFPY LRWIPNTRME TKIQRLYFRR KAVMTALINE QKKRIASGEE INCYIDFLLK    300
EGKTLTMDQI SMLLWETVIE TADTTMVTTE WAMYEVAKDS KRQDRLYQEI QKVCGSEMVT    360
EEYLSQLPYL NAVFHETLRK HSPAALVPLR YAHEDTQLGG YYIPAGTEIA INIYGCNMDK    420
HQWESPEEWK PERFLDPKFD PMDLYKTMAF GAGKRVCAGS LQAMLIACPT IGRLVQEFEW    480
KLRDGEEENV DTVGLTTHKR YPMHAILKPR S                                   511
```

TABLE 10-continued

Sequences disclosed herein.

SEQ ID NO: 118

```
MATSDSIVDD RKQLHVATFP WLAFGHILPY LQLSKLIAEK GHKVSFLSTT RNIQRLSSHI      60
SPLINVVQLT LPRVQELPED AEATTDVHPE DIPYLKKASD GLQPEVTRFL EQHSPDWIIY     120
DYTHYWLPSI AASLGISRAH FSVTTPWAIA YMGPSADAMI NGSDGRTTVE DLTTPPKWFP     180
FPTKVCWRKH DLARLVPYKA PGISDGYRMG MVLKGSDCLL SKCYHEFGTQ WLPLLETLHQ     240
VPVVPVGLLP PEIPGDEKDE TWVSIKKWLD GKQKGSVVYV ALGSEVLVSQ TEVVELALGL     300
ELSGLPFVWA YRKPKGPAKS DSVELPDGFV ERTRDRGLVW TSWAPQLRIL SHESVCGFLT     360
HCGSGSIVEG LMFGHPLIML PIFGDQPLNA RLLEDKQVGI EIPRNEEDGC LTKESVARSL     420
RSVVVEKEGE IYKANARELS KIYNDTKVEK EYVSQFVDYL EKNARAVAID HES            473
```

SEQ ID NO: 119

```
MATSDSIVDD RKQLHVATFP WLAFGHILPY LQLSKLIAEK GHKVSFLSTT RNIQRLSSHI      60
SPLINVVQLT LPRVQELPED AEATTDVHPE DIPYLKKASD GLQPEVTRFL EQHSPDWIIY     120
DYTHYWLPSI AASLGISRAH FSVTTPWAIA YMGPSADAMI NGSDGRTTVE DLTTPPKWFP     180
FPTKVCWRKH DLARGVPYKA PGISDGYRMG LVLKGSDCLL SKCYHEFGTQ WLPLLETLHQ     240
VPVVPVGLLP PEIPGDEKDE TWVSIKKWLD GKQKGSVVYV ALGSEVLVSQ TEVVELALGL     300
ELSGLPFVWA YRKPKGPAKS DSVELPDGFV ERTRDRGLVW TSWAPQLRIL SHESVCGFLT     360
HCGSGSIVEG LMFGHPLIML PIFGDQPLNA RLLEDKQVGI EIPRNEEDGC LTKESVARSL     420
RSVVVEKEGE IYKANARELS KIYNDTKVEK EYVSQFVDYL EKNARAVAID HES            473
```

SEQ ID NO: 120

```
MATSDSIVDD RKQLHVATFP WLAFGHILPY LQLSKLIAEK GHKVSFLSTT RNIQRLSSHI      60
SPLINVVQLT LPRVQELPED AEATTDVHPE DIPYLKKASD GLQPEVTRFL EQHSPDWIIY     120
DYTHYWLPSI AASLGISRAH FSVTTPWAIA YMGPSADAMI NGSDGRTTVE DLTTPPKWFP     180
FPTKVCWRKH DLARLPPYKA PGISDGYRMG LVLKGSDCLL SKCYHEFGTQ WLPLLETLHQ     240
VPVVPVGLLP PEIPGDEKDE TWVSIKKWLD GKQKGSVVYV ALGSEVLVSQ TEVVELALGL     300
ELSGLPFVWA YRKPKGPAKS DSVELPDGFV ERTRDRGLVW TSWAPQLRIL SHESVCGFLT     360
HCGSGSIVEG LMFGHPLIML PIFGDQPLNA RLLEDKQVGI EIPRNEEDGC LTKESVARSL     420
RSVVVEKEGE IYKANARELS KIYNDTKVEK EYVSQFVDYL EKNARAVAID HES            473
```

SEQ ID NO: 121

```
MATSDSIVDD RKQLHVATFP WLAFGHILPY LQLSKLIAEK GHKVSFLSTT RNIQRLSSHI      60
SPLINVVQLT LPRVQELPED AEATTDVHPE DIPYLKKASD GLQPEVTRFL EQHSPDWIIY     120
DYTHYWLPSI AASLGISRAH FSVTTPWAIA YMGPSADAMI NGSDGRTTVE DLTTPPKWFP     180
FPTKVCWRKH DLARLVPYKA PGISDGYRMG HVLKGSDCLL SKCYHEFGTQ WLPLLETLHQ     240
VPVVPVGLLP PEIPGDEKDE TWVSIKKWLD GKQKGSVVYV ALGSEVLVSQ TEVVELALGL     300
ELSGLPFVWA YRKPKGPAKS DSVELPDGFV ERTRDRGLVW TSWAPQLRIL SHESVCGFLT     360
HCGSGSIVEG LMFGHPLIML PIFGDQPLNA RLLEDKQVGI EIPRNEEDGC LTKESVARSL     420
RSVVVEKEGE IYKANARELS KIYNDTKVEK EYVSQFVDYL EKNARAVAID HES            473
```

SEQ ID NO: 122

```
MDSGYSSSYA AAGMHVVIC PWLAFGHLLP CLDLAQRLAS RGHRVSFVST PRNISRLPPV       60
RPALAPLVAF VALPLPRVEG LPDGAESTND VPHDRPDMVE LHRRAFDGLA APFSEFLGTA     120
CADWVIVDVF HHWAAAAALE HKVPCAMMLL GSAHMIASIA DRRLERAETE SPAAAGQGRP     180
AAAPTFEVAR MKLIRTKGSS GMSLAERFSL TLSRSSLVVG RSCVEFEPET VPLLSTLRGK     240
PITFLGLMPP LHEGRREDGE DATVRWLDAQ PAKSVVYVAL GSEVPLGVEK VHELALGLEL     300
AGTRFLWALR KPTGVSDADL LPAGFEERTR GRGVVATRWV PQMSILAHAA VGAFLTHCGW     360
NSTIEGLMFG HPLIMLPIFG DQGPNARLIE AKNAGLQVPR NEEDGCLTKE SVARSLRSVV     420
VEKEGEIYKA NARELSKIYN DTKVEKEYVS QFVDYLEKNA RAVAIDHES                 469
```

SEQ ID NO: 123

```
MATSDSIVDD RKQLHVATFP WLAFGHILPY LQLSKLIAEK GHKVSFLSTT RNIQRLSSHI      60
SPLINVVQLT LPRVQELPED AEATTDVHPE DIPYLKKASD GLQPEVTRFL EQHSPDWIIY     120
DYTHYWLPSI AASLGISRAH FSVTTPWAIA YMGPSADAMI NGSDGRTTVE DLTTPPKWFP     180
FPTKVCWRKH DLARCVPYKA PGISDGYRMG LVLKGSDCLL SKCYHEFGTQ WLPLLETLHQ     240
VPVVPVGLLP PEIPGDEKDE TWVSIKKWLD GKQKGSVVYV ALGSEVLVSQ TEVVELALGL     300
ELSGLPFVWA YRKPKGPAKS DSVELPDGFV ERTRDRGLVW TSWAPQLRIL SHESVCGFLT     360
HCGSGSIVEG LMFGHPLIML PIFGDQPLNA RLLEDKQVGI EIPRNEEDGC LTKESVARSL     420
RSVVVEKEGE IYKANARELS KIYNDTKVEK EYVSQFVDYL EKNARAVAID HES            473
```

SEQ ID NO: 124

```
MDSGYSSSYA AAGMHVVIC PWLAFGHLLP CLDLAQRLAS RGHRVSFVST PRNISRLPPV       60
RPALAPLVAF VALPLPRVEG LPDGAESTND VPHDRPDMVE LHRRAFDGLA APFSEFLGTA     120
CADWVIVDVF HHWLPSIAAS LGISRAHFSV TTPWAIAYMG PSADAMINGS DGRTTVEDLT     180
TPPKWFPFPT KVCWRKHDLA RLVPYKAPGI SDGYRMGMVL KGSDCLLSKC YHEFGTQWLP     240
LLETLHQVPV VPVGLMPPLH EGRREDGEDA TVRWLDAQPA KSVVYVALGS EVPLGVEKVH     300
ELALGLELAG TRFLWALRKP TGVSDADLLP AGFEERTRGR GVVATRWVPQ MSILAHAAVG     360
AFLTHCGWNS TIEGLMFGHP LIMLPIFGDQ GPNARLIEAK NAGLQVARND GDGSFDREGV     420
AAAIRAVAVE EESSKVFQAK AKKLQEIVAD MACHERYIDG FIQQLRSYKD                470
```

TABLE 10-continued

Sequences disclosed herein.

SEQ ID NO: 125

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWAAAA ALEHKVPCAM MLLGSAHMIA SIADRRLERA ETESPAAAGQ GRPAAAPTFE   180
VARMKLIRTK GSSGMSLAER FSLTLSRSSL VVGRSCVEFE PETVPLLSTL RGKPITFLGL   240
MPPLHEGRRE DGEDATVRWL DAQPAKSVVY VALGSEVPLG VEKVHELALG LELAGTRFLW   300
ALRKPTGVSD ADLLPAGFEE RTRGRGVVAT RWVPQMSILA HAAVGAFLTH CGWNSTIEGL   360
MFGHPLIMLP IFGDQGPNAR LIEAKNAGLQ VARNDGDGSF DREGVAAAIR AVAVEEESSK   420
VFQAKAKKLQ EIVADMACHE RYIDGFIQQL RSYKD                             455
```

SEQ ID NO: 126

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG MVLKGSDCLL SKCYHEFGTQ WLPLLETLHQ   240
VPVVPVGLLP PEIPGDEKDE TWVSIKKWLD GKQKGSVVYV ALGSEALVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIARNDGDGS FDREGVAAAI   420
RAVAVEEESS KVFQAKAKKL QEIVADMACH ERYIDGFIQQ LRSYKD                 466
```

SEQ ID NO: 127

```
MDAMATTEKK PHVIFIPFPA QSHIKAMLKL AQLLHHKGLQ ITFVNTDFIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIPHTFD ELEPSIIKTL   240
SLRYNHIYTI GPLQLLLDQI PEEKKQTGIT SLHGYSLVKE EPECFQWLQS KEPNSVVYVN   300
FGSSTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                  481
```

SEQ ID NO: 128

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWAAAA ALEHKVPCAM MLLGSAHMIA SIADRRLERA ETESPAAAGQ GRPAAAPTFE   180
VARMKLIRTK GSSGMSLAER FSLTLSRSSL VVGRSCVEFE PETVPLLSTL RGKPITFLGL   240
LPPEIPGDEK DETWVSIKKW LDGKQKGSVV YVALGSEALV SQTEVVELAL GLELSGLPFV   300
WAYRKPKGPA KSDSVELPDG FVERTRDRGL VWTSWAPQLR ILSHESVCGF LTHCGSGSIV   360
EGLMFGHPLI MLPIFGDQPL NARLLEDKQV GIEIPRNEED GCLTKESVAR SLRSVVVEKE   420
GEIYKANARE LSKIYNDTKV EKEYVSQFVD YLEKNARAVA IDHES                  465
```

SEQ ID NO: 129

```
MDSGYSSSYA AAGMHVVIC PWLAFGHLLP CLDLAQRLAS RGHRVSFVST PRNISRLPPV    60
RPALAPLVAF VALPLPRVEG LPDGAESTND VPHDRPDMVE LHRRAFDGLA APFSEFLGTA   120
CADWVIVDVF HHWLPSIAAS LGISRAHFSV TTPWAIAYMG PSADAMINGS DGRTTVEDLT   180
TPPKWFPFPT KVCWRKHDLA RLVPYKAPGI SDGYRMGMVL KGSDCLLSKC YHEFGTQWLP   240
LLETLHQVPV VPVGLLPPEI PGDEKDETWV SIKKWLDGKQ KGSVVYVALG SEALVSQTEV   300
VELALGLELS GLPFVWAYRK PKGPAKSDSV ELPDGFVERT RDRGLVWTSW APQLRILSHE   360
SVCGFLTHCG SGSIVEGLMF GHPLIMLPIF GDQPLNARLL EDKQVGIEIP RNEEDGCLTK   420
ESVARSLRSV VVEKEGEIYK ANARELSKIY NDTKVEKEYV SQFVDYLEKN ARAVAIDHES   480
```

SEQ ID NO: 130

```
MDSGYSSSYA AAGMHVVIC PWLAFGHLLP CLDLAQRLAS RGHRVSFVST PRNISRLPPV    60
RPALAPLVAF VALPLPRVEG LPDGAESTND VPHDRPDMVE LHRRAFDGLA APFSEFLGTA   120
CADWVIVDVF HHWAAAAALE HKVPCAMMLL GSAHMIASIA DRRLERAETE SPAAAGQGRP   180
AAAPTFEVAR MKLIRTKGSS GMSLAERFSL TLSRSSLVVG RSCVEFEPET VPLLSTLRGK   240
PITFLGLLPP EIPGDEKDET WVSIKKWLDG KQKGSVVYVA LGSEALVSQT EVVELALGLE   300
LSGLPFVWAY RKPKGPAKSD SVELPDGFVE RTRDRGLVWT SWAPQLRILS HESVCGFLTH   360
CGSGSIVEGL MFGHPLIMLP IFGDQPLNAR LLEDKQVGIE IPRNEEDGCL TKESVARSLR   420
SVVVEKEGEI YKANARELSK IYNDTKVEKE YVSQFVDYLE KNARAVAIDH ES          472
```

SEQ ID NO: 131

```
MDSGYSSSYA AAGMHVVIC PWLAFGHLLP CLDLAQRLAS RGHRVSFVST PRNISRLPPV    60
RPALAPLVAF VALPLPRVEG LPDGAESTND VPHDRPDMVE LHRRAFDGLA APFSEFLGTA   120
CADWVIVDVF HHWLPSIAAS LGISRAHFSV TTPWAIAYMG PSADAMINGS DGRTTVEDLT   180
TPPKWFPFPT KVCWRKHDLA RLVPYKAPGI SDGYRMGMVL KGSDCLLSKC YHEFGTQWLP   240
LLETLHQVPV VPVGLLPPEI PGDEKDETWV SIKKWLDGKQ KGSVVYVALG SEALVSQTEV   300
VELALGLELS GLPFVWAYRK PKGPAKSDSV ELPDGFVERT RDRGLVWTSW APQLRILSHE   360
SVCGFLTHCG SGSIVEGLMF GHPLIMLPIF GDQPLNARLL EDKQVGIEIA RNDGDGSFDR   420
EGVAAAIRAV AVEEESSKVF QAKAKKLQEI VADMACHERY IDGFIQQLRS YKD         473
```

TABLE 10-continued

Sequences disclosed herein.

SEQ ID NO: 132

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWLPSI | AASLGISRAH | FSVTTPWAIA | YMGPSADAMI | NGSDGRTTVE | DLTTPPKWFP | 180
| FPTKVCWRKH | DLARLVPYKA | PGISDGYRMG | MVLKGSDCLL | SKCYHEFGTQ | WLPLLETLHQ | 240
| VPVVPVGLMP | PLHEGRREDG | EDATVRWLDA | QPAKSVVYVA | LGSEVPLGVE | KVHELALGLE | 300
| LAGTRFLWAL | RKPTGVSDAD | LLPAGFEERT | RGRGVVATRW | VPQMSILAHA | AVGAFLTHCG | 360
| WNSTIEGLMF | GHPLIMLPIF | GDQGPNARLI | EAKNAGLQVA | RNDGDGSFDR | EGVAAAIRAV | 420
| AVEEESSKVF | QAKAKKLQEI | VADMACHERY | IDGFIQQLRS | YKD | | 463

SEQ ID NO: 133

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWAAAA | ALEHKVPCAM | MLLGSAHMIA | SIADRRLERA | ETESPAAAGQ | GRPAAAPTFE | 180
| VARMKLIRTK | GSSGMSLAER | FSLTLSRSSL | VVGRSCVEFE | PETVPLLSTL | RGKPITFLGL | 240
| MPPLHEGRRE | DGEDATVRWL | DAQPAKSVVY | VALGSEVPLG | VEKVHELALG | LELAGTRFLW | 300
| ALRKPTGVSD | ADLLPAGFEE | RTRGRGVVAT | RWVPQMSILA | HAAVGAFLTH | CGWNSTIEGL | 360
| MFGHPLIMLP | IFGDQGPNAR | LIEAKNAGLQ | VPRNEEDGCL | TKESVARSLR | SVVVEKEGEI | 420
| YKANARELSK | IYNDTKVEKE | YVSQFVDYLE | KNARAVAIDH | ES | | 462

SEQ ID NO: 134

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWAAAA | ALEHKVPCAM | MLLGSAHMIA | SIADRRLERA | ETESPAAAGQ | GRPAAAPTFE | 180
| VARMKLIRTK | GSSGMSLAER | FSLTLSRSSL | VVGRSCVEFE | PETVPLLSTL | RGKPITFLGL | 240
| LPPEIPGDEK | DETWSIKKW | LDGKQKGSVV | YVALGSEALV | SQTEVVELAL | GLELSGLPFV | 300
| WAYRKPKGPA | KSDSVELPDG | FVERTRDRGL | VWTSWAPQLR | ILSHESVCGF | LTHCGSGSIV | 360
| EGLMFGHPLI | MLPIFGDQPL | NARLLEDKQV | GIEIARNDGD | GSFDREGVAA | AIRAVAVEEE | 420
| SSKVFQAKAK | KLQEIVADMA | CHERYIDGFI | QQLRSYKD | | | 458

SEQ ID NO: 135 ggcaagccac gtttggtg 18

SEQ ID NO: 136 ggagctgcat gtgtcagagg 20

SEQ ID NO: 137 cgatgtattt catcactggt tgccatccat cgcggct 37

SEQ ID NO: 138 agccgcgatg gatggcaacc agtgatgaaa tacatcg 37

SEQ ID NO: 139 ttatgattat actcactact gggctgctgc agccgcattg 40

SEQ ID NO: 140 agccgcgatg gatggcaacc agtgatgaaa tacatcg 37

SEQ ID NO: 141 caaacctatt actttccttg gtttactgcc accggaaata c 41

SEQ ID NO: 142 gtatttccgg tggcagtaaa ccaaggaaag taataggttt g 41

SEQ ID NO: 143 ccggtggttc cggtgggact aatgcctcca ttacatga 38

SEQ ID NO: 144 tcatgtaatg gaggcattag tcccaccgga accaccgg 38

SEQ ID NO: 145 gaacgcaggt ctgcaggttc aagaaatga ggaagatgg 39

TABLE 10-continued

Sequences disclosed herein.

SEQ ID NO: 146 ccatcttcct catttcttgg aacctgcaga cctgcgttc                                 39

SEQ ID NO: 147

| | | | | |
|---|---|---|---|---|
| MDAMATTEKK | PHVIFIPFPA | LSHIKAMLKL | AQLLHHKGLQ | ITFVNTDFIH | NQFLESSGPH | 60 |
| CLDGAPGFRF | ETIPDGVSHS | PEASIPIRES | LLRSIETNFL | DRFIDLVTKL | PDPPTCIISD | 120 |
| GFLSVFTIDA | AKKLGIPVMM | YWTLAACGFM | GFYHIHSLIE | KGFAPLKDAS | YLTNGYLDTV | 180 |
| IDWVPGMEGI | RLKDFPLDWS | TDLNDKVLMF | TTEAPQRSHK | VSHHIFHTFD | ELEPSIIKTL | 240 |
| SLRYNHIYTI | GPLQLLLDQI | PEEKKQTGIT | SLHGYSLVKE | EPECFQWLQS | KEPNSVVYVN | 300 |
| FGSTTVMSLE | DMTEFGWGLA | NSNHYFLWII | RSNLVIGENA | VLPPELEEHI | KKRGFIASWC | 360 |
| SQEKVLKHPS | VGGFLTHCGW | GSTIESLSAG | VPMICWPYSW | DQLTNCRYIC | KEWEVGLEMG | 420 |
| TKVKRDEVKR | LVQELMGEGG | HKMRNKAKDW | KEKARIAIAP | NGSSSLNIDK | MVKEITVLAR | 480 |
| N | | | | | | 481 |

SEQ ID NO: 148

MDAMATTEKK PHVIFIPFPA TSHIKAMLKL AQLLHHKGLQ ITFVNTDFIH NQFLESSGPH   60
CLDGAPGFRF ETIPDGVSHS PEASIPIRES LLRSIETNFL DRFIDLVTKL PDPPTCIISD  120
GFLSVFTIDA AKKLGIPVMM YWTLAACGFM GFYHIHSLIE KGFAPLKDAS YLTNGYLDTV  180
IDWVPGMEGI RLKDFPLDWS TDLNDKVLMF TTEAPQRSHK VSHHIFHTFD ELEPSIIKTL  240
SLRYNHIYTI GPLQLLLDQI PEEKKQTGIT SLHGYSLVKE EPECFQWLQS KEPNSVVYVN  300
FGSTTVMSLE DMTEFGWGLA NSNHYFLWII RSNLVIGENA VLPPELEEHI KKRGFIASWC  360
SQEKVLKHPS VGGFLTHCGW GSTIESLSAG VPMICWPYSW DQLTNCRYIC KEWEVGLEMG  420
TKVKRDEVKR LVQELMGEGG HKMRNKAKDW KEKARIAIAP NGSSSLNIDK MVKEITVLAR  480
N                                                                 481

SEQ ID NO: 149

MDAMATTEKK PHVIFIPFPA VSHIKAMLKL AQLLHHKGLQ ITFVNTDFIH NQFLESSGPH   60
CLDGAPGFRF ETIPDGVSHS PEASIPIRES LLRSIETNFL DRFIDLVTKL PDPPTCIISD  120
GFLSVFTIDA AKKLGIPVMM YWTLAACGFM GFYHIHSLIE KGFAPLKDAS YLTNGYLDTV  180
IDWVPGMEGI RLKDFPLDWS TDLNDKVLMF TTEAPQRSHK VSHHIFHTFD ELEPSIIKTL  240
SLRYNHIYTI GPLQLLLDQI PEEKKQTGIT SLHGYSLVKE EPECFQWLQS KEPNSVVYVN  300
FGSTTVMSLE DMTEFGWGLA NSNHYFLWII RSNLVIGENA VLPPELEEHI KKRGFIASWC  360
SQEKVLKHPS VGGFLTHCGW GSTIESLSAG VPMICWPYSW DQLTNCRYIC KEWEVGLEMG  420
TKVKRDEVKR LVQELMGEGG HKMRNKAKDW KEKARIAIAP NGSSSLNIDK MVKEITVLAR  480
N                                                                 481

SEQ ID NO: 150

MDAMATTEKK PHVIFIPFPA QSHIKAMLKL AQLLHHKGLQ ITFVNTDSIH NQFLESSGPH   60
CLDGAPGFRF ETIPDGVSHS PEASIPIRES LLRSIETNFL DRFIDLVTKL PDPPTCIISD  120
GFLSVFTIDA AKKLGIPVMM YWTLAACGFM GFYHIHSLIE KGFAPLKDAS YLTNGYLDTV  180
IDWVPGMEGI RLKDFPLDWS TDLNDKVLMF TTEAPQRSHK VSHHIFHTFD ELEPSIIKTL  240
SLRYNHIYTI GPLQLLLDQI PEEKKQTGIT SLHGYSLVKE EPECFQWLQS KEPNSVVYVN  300
FGSTTVMSLE DMTEFGWGLA NSNHYFLWII RSNLVIGENA VLPPELEEHI KKRGFIASWC  360
SQEKVLKHPS VGGFLTHCGW GSTIESLSAG VPMICWPYSW DQLTNCRYIC KEWEVGLEMG  420
TKVKRDEVKR LVQELMGEGG HKMRNKAKDW KEKARIAIAP NGSSSLNIDK MVKEITVLAR  480
N                                                                 481

SEQ ID NO: 151

MDAMATTEKK PHVIFIPFPA QSHIKAMLKL AQLLHHKGLQ ITFVNTDHIH NQFLESSGPH   60
CLDGAPGFRF ETIPDGVSHS PEASIPIRES LLRSIETNFL DRFIDLVTKL PDPPTCIISD  120
GFLSVFTIDA AKKLGIPVMM YWTLAACGFM GFYHIHSLIE KGFAPLKDAS YLTNGYLDTV  180
IDWVPGMEGI RLKDFPLDWS TDLNDKVLMF TTEAPQRSHK VSHHIFHTFD ELEPSIIKTL  240
SLRYNHIYTI GPLQLLLDQI PEEKKQTGIT SLHGYSLVKE EPECFQWLQS KEPNSVVYVN  300
FGSTTVMSLE DMTEFGWGLA NSNHYFLWII RSNLVIGENA VLPPELEEHI KKRGFIASWC  360
SQEKVLKHPS VGGFLTHCGW GSTIESLSAG VPMICWPYSW DQLTNCRYIC KEWEVGLEMG  420
TKVKRDEVKR LVQELMGEGG HKMRNKAKDW KEKARIAIAP NGSSSLNIDK MVKEITVLAR  480
N                                                                 481

SEQ ID NO: 152

MDAMATTEKK PHVIFIPFPA QSHIKAMLKL AQLLHHKGLQ ITFVNTDYIH NQFLESSGPH   60
CLDGAPGFRF ETIPDGVSHS PEASIPIRES LLRSIETNFL DRFIDLVTKL PDPPTCIISD  120
GFLSVFTIDA AKKLGIPVMM YWTLAACGFM GFYHIHSLIE KGFAPLKDAS YLTNGYLDTV  180
IDWVPGMEGI RLKDFPLDWS TDLNDKVLMF TTEAPQRSHK VSHHIFHTFD ELEPSIIKTL  240
SLRYNHIYTI GPLQLLLDQI PEEKKQTGIT SLHGYSLVKE EPECFQWLQS KEPNSVVYVN  300
FGSTTVMSLE DMTEFGWGLA NSNHYFLWII RSNLVIGENA VLPPELEEHI KKRGFIASWC  360
SQEKVLKHPS VGGFLTHCGW GSTIESLSAG VPMICWPYSW DQLTNCRYIC KEWEVGLEMG  420
TKVKRDEVKR LVQELMGEGG HKMRNKAKDW KEKARIAIAP NGSSSLNIDK MVKEITVLAR  480
N                                                                 481

TABLE 10-continued

Sequences disclosed herein.

SEQ ID NO: 153

```
MDAMATTEKK PHVIFIPFPA QSHIKAMLKL AQLLHHKGLQ ITFVNTDRIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                 481
```

SEQ ID NO: 154

```
MDAMATTEKK PHVIFIPFPA QSHIKAMLKL AQLLHHKGLQ ITFVNTDQIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                 481
```

SEQ ID NO: 155

```
MDAMATTEKK PHVIFIPFPA QSHIKAMLKL AQLLHHKGLQ ITFVNTDWIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                 481
```

SEQ ID NO: 156

```
MDAMATTEKK PHVIFIPFPA QSHIKAMLKL AQLLHHKGLQ ITFVNTDTIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                 481
```

SEQ ID NO: 157

```
MDAMATTEKK PHVIFIPFPA QSHIKAMLKL AQLLHHKGLQ ITFVNTDFVH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                 481
```

SEQ ID NO: 158

```
MDAMATTEKK PHVIFIPFPA QSHIKAMLKL AQLLHHKGLQ ITFVNTDFIH NQFLESSGPH    60
CLDGAPGFRF ETIPDGVSHS PEAGIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                 481
```

SEQ ID NO: 159

```
MDAMATTEKK PHVIFIPFPA QSHIKAMLKL AQLLHHKGLQ ITFVNTDFIH NQFLESSGPH    60
CLDGAPGFRF ETIPDGVSHS PEAAIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
```

TABLE 10-continued

Sequences disclosed herein.

```
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                    481
```

SEQ ID NO: 160

```
MDAMATTEKK PHVIFIPFPA QSHIKAMLKL AQLLHHKGLQ ITFVNTDFIH NQFLESSGPH     60
CLDGAPGFRF ETIPDGVSHS PEATIPIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                    481
```

SEQ ID NO: 161

```
MDAMATTEKK PHVIFIPFPA QSHIKAMLKL AQLLHHKGLQ ITFVNTDFIH NQFLESSGPH     60
CLDGAPGFRF ETIPDGVSHS PEACIPIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                    481
```

SEQ ID NO: 162

```
MDAMATTEKK PHVIFIPFPA QSHIKAMLKL AQLLHHKGLQ ITFVNTDFIH NQFLESSGPH     60
CLDGAPGFRF ETIPDGVSHS PEAPIPIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                    481
```

SEQ ID NO: 163

```
MDAMATTEKK PHVIFIPFPA QSHIKAMLKL AQLLHHKGLQ ITFVNTDFIH NQFLESSGPH     60
CLDGAPGFRF ETIPDGVSHS PEANIPIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                    481
```

SEQ ID NO: 164

```
MDAMATTEKK PHVIFIPFPA QSHIKAMLKL AQLLHHKGLQ ITFVNTDFIH NQFLESSGPH     60
CLDGAPGFRF ETIPDGVSHS PEAVIPIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                    481
```

SEQ ID NO: 165

```
MDAMATTEKK PHVIFIPFPA QSHIKAMLKL AQLLHHKGLQ ITFVNTDFIH NQFLESSGPH     60
CLDGAPGFRF ETIPDGVSHS PEASIRIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                    481
```

TABLE 10-continued

Sequences disclosed herein.

SEQ ID NO: 166

| | | | | | |
|---|---|---|---|---|---|
|MDAMATTEKK|PHVIFIPFPA|QSHIKAMLKL|AQLLHHKGLQ|ITFVNTDFIH|NQFLESSGPH|60|
|CLDGAPGFRF|ETIPDGVSHS|PEASIGIRES|LLRSIETNFL|DRFIDLVTKL|PDPPTCIISD|120|
|GFLSVFTIDA|AKKLGIPVMM|YWTLAACGFM|GFYHIHSLIE|KGFAPLKDAS|YLTNGYLDTV|180|
|IDWVPGMEGI|RLKDFPLDWS|TDLNDKVLMF|TTEAPQRSHK|VSHHIFHTFD|ELEPSIIKTL|240|
|SLRYNHIYTI|GPLQLLLDQI|PEEKKQTGIT|SLHGYSLVKE|EPECFQWLQS|KEPNSVVYVN|300|
|FGSTTVMSLE|DMTEFGWGLA|NSNHYFLWII|RSNLVIGENA|VLPPELEEHI|KKRGFIASWC|360|
|SQEKVLKHPS|VGGFLTHCGW|GSTIESLSAG|VPMICWPYSW|DQLTNCRYIC|KEWEVGLEMG|420|
|TKVKRDEVKR|LVQELMGEGG|HKMRNKAKDW|KEKARIAIAP|NGSSSLNIDK|MVKEITVLAR|480|
|N||||||481|

SEQ ID NO: 167

| | | | | | |
|---|---|---|---|---|---|
|MDAMATTEKK|PHVIFIPFPA|QSHIKAMLKL|AQLLHHKGLQ|ITFVNTDFIH|NQFLESSGPH|60|
|CLDGAPGFRF|ETIPDGVSHS|PEASIPHRES|LLRSIETNFL|DRFIDLVTKL|PDPPTCIISD|120|
|GFLSVFTIDA|AKKLGIPVMM|YWTLAACGFM|GFYHIHSLIE|KGFAPLKDAS|YLTNGYLDTV|180|
|IDWVPGMEGI|RLKDFPLDWS|TDLNDKVLMF|TTEAPQRSHK|VSHHIFHTFD|ELEPSIIKTL|240|
|SLRYNHIYTI|GPLQLLLDQI|PEEKKQTGIT|SLHGYSLVKE|EPECFQWLQS|KEPNSVVYVN|300|
|FGSTTVMSLE|DMTEFGWGLA|NSNHYFLWII|RSNLVIGENA|VLPPELEEHI|KKRGFIASWC|360|
|SQEKVLKHPS|VGGFLTHCGW|GSTIESLSAG|VPMICWPYSW|DQLTNCRYIC|KEWEVGLEMG|420|
|TKVKRDEVKR|LVQELMGEGG|HKMRNKAKDW|KEKARIAIAP|NGSSSLNIDK|MVKEITVLAR|480|
|N||||||481|

SEQ ID NO: 168

| | | | | | |
|---|---|---|---|---|---|
|MDAMATTEKK|PHVIFIPFPA|QSHIKAMLKL|AQLLHHKGLQ|ITFVNTDFIH|NQFLESSGPH|60|
|CLDGAPGFRF|ETIPDGVSHS|PEASIPPRES|LLRSIETNFL|DRFIDLVTKL|PDPPTCIISD|120|
|GFLSVFTIDA|AKKLGIPVMM|YWTLAACGFM|GFYHIHSLIE|KGFAPLKDAS|YLTNGYLDTV|180|
|IDWVPGMEGI|RLKDFPLDWS|TDLNDKVLMF|TTEAPQRSHK|VSHHIFHTFD|ELEPSIIKTL|240|
|SLRYNHIYTI|GPLQLLLDQI|PEEKKQTGIT|SLHGYSLVKE|EPECFQWLQS|KEPNSVVYVN|300|
|FGSTTVMSLE|DMTEFGWGLA|NSNHYFLWII|RSNLVIGENA|VLPPELEEHI|KKRGFIASWC|360|
|SQEKVLKHPS|VGGFLTHCGW|GSTIESLSAG|VPMICWPYSW|DQLTNCRYIC|KEWEVGLEMG|420|
|TKVKRDEVKR|LVQELMGEGG|HKMRNKAKDW|KEKARIAIAP|NGSSSLNIDK|MVKEITVLAR|480|
|N||||||481|

SEQ ID NO: 169

| | | | | | |
|---|---|---|---|---|---|
|MDAMATTEKK|PHVIFIPFPA|QSHIKAMLKL|AQLLHHKGLQ|ITFVNTDFIH|NQFLESSGPH|60|
|CLDGAPGFRF|ETIPDGVSHS|PEASIPMRES|LLRSIETNFL|DRFIDLVTKL|PDPPTCIISD|120|
|GFLSVFTIDA|AKKLGIPVMM|YWTLAACGFM|GFYHIHSLIE|KGFAPLKDAS|YLTNGYLDTV|180|
|IDWVPGMEGI|RLKDFPLDWS|TDLNDKVLMF|TTEAPQRSHK|VSHHIFHTFD|ELEPSIIKTL|240|
|SLRYNHIYTI|GPLQLLLDQI|PEEKKQTGIT|SLHGYSLVKE|EPECFQWLQS|KEPNSVVYVN|300|
|FGSTTVMSLE|DMTEFGWGLA|NSNHYFLWII|RSNLVIGENA|VLPPELEEHI|KKRGFIASWC|360|
|SQEKVLKHPS|VGGFLTHCGW|GSTIESLSAG|VPMICWPYSW|DQLTNCRYIC|KEWEVGLEMG|420|
|TKVKRDEVKR|LVQELMGEGG|HKMRNKAKDW|KEKARIAIAP|NGSSSLNIDK|MVKEITVLAR|480|
|N||||||481|

SEQ ID NO: 170

| | | | | | |
|---|---|---|---|---|---|
|MDAMATTEKK|PHVIFIPFPA|QSHIKAMLKL|AQLLHHKGLQ|ITFVNTDFIH|NQFLESSGPH|60|
|CLDGAPGFRF|ETIPDGVSHS|PEASIPYRES|LLRSIETNFL|DRFIDLVTKL|PDPPTCIISD|120|
|GFLSVFTIDA|AKKLGIPVMM|YWTLAACGFM|GFYHIHSLIE|KGFAPLKDAS|YLTNGYLDTV|180|
|IDWVPGMEGI|RLKDFPLDWS|TDLNDKVLMF|TTEAPQRSHK|VSHHIFHTFD|ELEPSIIKTL|240|
|SLRYNHIYTI|GPLQLLLDQI|PEEKKQTGIT|SLHGYSLVKE|EPECFQWLQS|KEPNSVVYVN|300|
|FGSTTVMSLE|DMTEFGWGLA|NSNHYFLWII|RSNLVIGENA|VLPPELEEHI|KKRGFIASWC|360|
|SQEKVLKHPS|VGGFLTHCGW|GSTIESLSAG|VPMICWPYSW|DQLTNCRYIC|KEWEVGLEMG|420|
|TKVKRDEVKR|LVQELMGEGG|HKMRNKAKDW|KEKARIAIAP|NGSSSLNIDK|MVKEITVLAR|480|
|N||||||481|

SEQ ID NO: 171

| | | | | | |
|---|---|---|---|---|---|
|MDAMATTEKK|PHVIFIPFPA|QSHIKAMLKL|AQLLHHKGLQ|ITFVNTDFIH|NQFLESSGPH|60|
|CLDGAPGFRF|ETIPDGVSHS|PEASIPIRES|KLRSIETNFL|DRFIDLVTKL|PDPPTCIISD|120|
|GFLSVFTIDA|AKKLGIPVMM|YWTLAACGFM|GFYHIHSLIE|KGFAPLKDAS|YLTNGYLDTV|180|
|IDWVPGMEGI|RLKDFPLDWS|TDLNDKVLMF|TTEAPQRSHK|VSHHIFHTFD|ELEPSIIKTL|240|
|SLRYNHIYTI|GPLQLLLDQI|PEEKKQTGIT|SLHGYSLVKE|EPECFQWLQS|KEPNSVVYVN|300|
|FGSTTVMSLE|DMTEFGWGLA|NSNHYFLWII|RSNLVIGENA|VLPPELEEHI|KKRGFIASWC|360|
|SQEKVLKHPS|VGGFLTHCGW|GSTIESLSAG|VPMICWPYSW|DQLTNCRYIC|KEWEVGLEMG|420|
|TKVKRDEVKR|LVQELMGEGG|HKMRNKAKDW|KEKARIAIAP|NGSSSLNIDK|MVKEITVLAR|480|
|N||||||481|

SEQ ID NO: 172

| | | | | | |
|---|---|---|---|---|---|
|MDAMATTEKK|PHVIFIPFPA|QSHIKAMLKL|AQLLHHKGLQ|ITFVNTDFIH|NQFLESSGPH|60|
|CLDGAPGFRF|ETIPDGVSHS|PEASIPIRES|RLRSIETNFL|DRFIDLVTKL|PDPPTCIISD|120|
|GFLSVFTIDA|AKKLGIPVMM|YWTLAACGFM|GFYHIHSLIE|KGFAPLKDAS|YLTNGYLDTV|180|
|IDWVPGMEGI|RLKDFPLDWS|TDLNDKVLMF|TTEAPQRSHK|VSHHIFHTFD|ELEPSIIKTL|240|

TABLE 10-continued

Sequences disclosed herein.

```
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                   481
```

SEQ ID NO: 173

```
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES TLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                   481
```

SEQ ID NO: 174

```
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LFRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                   481
```

SEQ ID NO: 175

```
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LIRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                   481
```

SEQ ID NO: 176

```
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LMRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                   481
```

SEQ ID NO: 177

```
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LLRSKETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                   481
```

SEQ ID NO: 178

```
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LLRSIETNFL DRFIDLVTKL PDPPTCIISD    120
GSLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                   481
```

TABLE 10-continued

Sequences disclosed herein.

SEQ ID NO: 179

```
MDAMATTEKK PHVIFIPFPA QSHIKAMLKL AQLLHHKGLQ ITFVNTDFIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNSVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                  481
```

SEQ ID NO: 180

```
MDAMATTEKK PHVIFIPFPA QSHIKAMLKL AQLLHHKGLQ ITFVNTDFIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYHIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNMVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
N                                                                  481
```

SEQ ID NO: 181

```
MENKTETTVR RRRRIILFPV PFHGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSSLLDH DRTVFQWLDQ QPPSSVLYVS FGSTSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 182

```
MENKTETTVR RRRRIILFPV PFQGHWNPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSSLLDH DRTVFQWLDQ QPPSSVLYVS FGSTSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 183

```
MENKTETTVR RRRRIILFPV PFQGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMGSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSSLLDH DRTVFQWLDQ QPPSSVLYVS FGSTSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 184

```
MENKTETTVR RRRRIILFPV PFQGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHALVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSSLLDH DRTVFQWLDQ QPPSSVLYVS FGSTSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 185

```
MENKTETTVR RRRRIILFPV PFQGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSGLLDH DRTVFQWLDQ QPPSSVLYVS FGSTSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

TABLE 10-continued

Sequences disclosed herein.

SEQ ID NO: 186

```
MENKTETTVR RRRRIILFPV PFQGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TAWSSSLLDH DRTVFQWLDQ QPPSSVLYVS FGSTSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 187

```
MENKTETTVR RRRRIILFPV PFQGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSSLLDH DRTVFQWLDQ QPPSSVLYVS FGSGSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 188

```
MENKTETTVR RRRRIILFPV PFQGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSSLLDH DRTVFQWLDQ QPPSSVLYVS FGNTSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 189

```
MENKTETTVR RRRRIILFPV PFQGHINPIL QLANVLYSKG FSITIFHTNF NKPKTSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSSLLDH DRTVFQWLDQ QPPSSVLYVS FGSTSEVDEK DFLEIARGLV   300
DSKQSFLWVV RPGFVKGSTW VEPLPDGFLG ERGRIVPWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 190

```
MENKTETTVR RRRRIILFPV PFQGHINPIL QLANVLYSKG FSITIFHTNF NKPKKSNYPH    60
FTFRFILDND PQDERISNLP THGPLAGMRI PIINEHGADE LRRELELLML ASEEDEEVSC   120
LITDALWYFA QSVADSLNLR RLVLMTSSLF NFHAHVSLPQ FDELGYLDPD DKTRLEEQAS   180
GFPMLKVKDI KSAYSNWQIL KEILGKMIKQ TKASSGVIWN SFKELEESEL ETVIREIPAP   240
SFLIPLPKHL TASSSSLLDH DRTVFQWLDQ QPPSSVLYVS FGSTSEVDEK DFLEIARGLV   300
DSKQSFLWVV RPGFVKGSTW VEPLPDGFLG ERGRIVKWVP QQEVLAHGAI GAFWTHSGWN   360
STLESVCEGV PMIFSDFGLD QPLNARYMSD VLKVGVYLEN GWERGEIANA IRRVMVDEEG   420
EYIRQNARVL KQKADVSLMK GGSSYESLES LVSYISSL                          458
```

SEQ ID NO: 191

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG LVEKGSDCLL SKCYHEFGTQ WLPLLETLHQ   240
VPVVPVGLLP PEIPGDEKDE TWVSIKKWLD GKQKGSVYYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES         473
```

SEQ ID NO: 192

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG LVLKGSDCLL YKCYHEFGTQ WLPLLETLHQ   240
VPVVPVGLLP PEIPGDEKDE TWVSIKKWLD GKQKGSVYYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES         473
```

TABLE 10-continued

Sequences disclosed herein.

SEQ ID NO: 193

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG LVLKGSDCLL SKCYHEFGTQ WLPLLETLHQ   240
VPVVPVGLLP PEIPGDEKDE TWVSIKKWLD GKQKGSVVYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARHLS KIYNDTKVEK EYVSQFVDYL EKNARAVAID HES          473
```

SEQ ID NO: 194

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YTGPSADAMI NGSDGRTTVE DLTTPPKWFP   180
FPTKVCWRKH DLARLVPYKA PGISDGYRMG LVLKGSDCLL SKCYHEFGTQ WLPLLETLHQ   240
VPVVPVGLLP PEIPGDEKDE TWVSIKKWLD GKQKGSVVYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473
```

SEQ ID NO: 195

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG CVLKGSDCLL SKCYHEFGTQ WLPLLETLHQ   240
VPVVPVGLLP PEIPGDEKDE TWVSIKKWLD GKQKGSVVYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473
```

SEQ ID NO: 196

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARSVPYKA PGISDGYRMG LVLKGSDCLL SKCYHEFGTQ WLPLLETLHQ   240
VPVVPVGLLP PEIPGDEKDE TWVSIKKWLD GKQKGSVVYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473
```

SEQ ID NO: 197

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARVVPYKA PGISDGYRMG LVLKGSDCLL SKCYHEFGTQ WLPLLETLHQ   240
VPVVPVGLLP PEIPGDEKDE TWVSIKKWLD GKQKGSVVYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473
```

SEQ ID NO: 198

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG LVLKGSDCLL SKCYHEFGTQ WLPLLETLHQ   240
VPVVPVGLLP PEIPGDEKDE TWVSIKKWLD GKQKGSVVYV ALGSESLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473
```

SEQ ID NO: 199

```
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG LVLKGSDCLL SKCYHEFGTQ WLPLLETLHQ   240
VPVVPVGLLP PEIPGDEKDE TWVSIKKWLD GKQKGSVVYV ALGSEVLVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473
```

TABLE 10-continued

Sequences disclosed herein.

SEQ ID NO: 200

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIVYLKKASD | GLQPEVTRFL | EQHSPDWIIY | 120
| DYTHYWLPSI | AASLGISRAH | FSVTTPWAIA | YGGPSADAMI | NGSDGRTTVE | DLTTPPKWFP | 180
| FPTKVCWRKH | DLARLVPYKA | PGISDGYRMG | LVLKGSDCLL | SKCYHEFGTQ | WLPLLETLHQ | 240
| VPVVPVGLLP | PEIPGDEKDE | TWVSIKKWLD | GKQKGSVVYV | ALGSEVLVSQ | TEVVELALGL | 300
| ELSGLPFVWA | YRKPKGPAKS | DSVELPDGFV | ERTRDRGLVW | TSWAPQLRIL | SHESVCGFLT | 360
| HCGSGSIVEG | LMFGHPLIML | PIFGDQPLNA | RLLEDKQVGI | EIPRNEEDGC | LTKESVARSL | 420
| RSVVVEKEGE | IYKANARELS | KIYNDTKVEK | EYVSQFVDYL | EKNARAVAID | HES | 473

SEQ ID NO: 201

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKAID | GLQPEVTRFL | EQHSPDWIIY | 120
| DYTHYWLPSI | AASLGISRAH | FSVTTPWAIA | YMGPSADAMI | NGSDGRTTVE | DLTTPPKWFP | 180
| FPTKVCWRKH | DLARLVPYKA | PGISDGYRMG | LVLKGSDCLL | SKCYHEFGTQ | WLPLLETLHQ | 240
| VPVVPVGLLP | PEIPGDEKDE | TWVSIKKWLD | GKQKGSVVYV | ALGSEVLVSQ | TEVVELALGL | 300
| ELSGLPFVWA | YRKPKGPAKS | DSVELPDGFV | ERTRDRGLVW | TSWAPQLRIL | SHESVCGFLT | 360
| HCGSGSIVEG | LMFGHPLIML | PIFGDQPLNA | RLLEDKQVGI | EIPRNEEDGC | LTKESVARSL | 420
| RSVVVEKEGE | IYKANARELS | KIYNDTKVEK | EYVSQFVDYL | EKNARAVAID | HES | 473

SEQ ID NO: 202

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWLPSI | AASLGISRAH | FSVKTPWAIA | YMGPSADAMI | NGSDGRTTVE | DLTTPPKWFP | 180
| FPTKVCWRKH | DLARLVPYKA | PGISDGYRMG | LVLKGSDCLL | SKCYHEFGTQ | WLPLLETLHQ | 240
| VPVVPVGLLP | PEIPGDEKDE | TWVSIKKWLD | GKQKGSVVYV | ALGSEVLVSQ | TEVVELALGL | 300
| ELSGLPFVWA | YRKPKGPAKS | DSVELPDGFV | ERTRDRGLVW | TSWAPQLRIL | SHESVCGFLT | 360
| HCGSGSIVEG | LMFGHPLIML | PIFGDQPLNA | RLLEDKQVGI | EIPRNEEDGC | LTKESVARSL | 420
| RSVVVEKEGE | IYKANARELS | KIYNDTKVEK | EYVSQFVDYL | EKNARAVAID | HES | 473

SEQ ID NO: 203

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWLPSI | AASLGISRAH | FSVLTPWAIA | YMGPSADAMI | NGSDGRTTVE | DLTTPPKWFP | 180
| FPTKVCWRKH | DLARLVPYKA | PGISDGYRMG | LVLKGSDCLL | SKCYHEFGTQ | WLPLLETLHQ | 240
| VPVVPVGLLP | PEIPGDEKDE | TWVSIKKWLD | GKQKGSVVYV | ALGSEVLVSQ | TEVVELALGL | 300
| ELSGLPFVWA | YRKPKGPAKS | DSVELPDGFV | ERTRDRGLVW | TSWAPQLRIL | SHESVCGFLT | 360
| HCGSGSIVEG | LMFGHPLIML | PIFGDQPLNA | RLLEDKQVGI | EIPRNEEDGC | LTKESVARSL | 420
| RSVVVEKEGE | IYKANARELS | KIYNDTKVEK | EYVSQFVDYL | EKNARAVAID | HES | 473

SEQ ID NO: 204

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWLPSI | AASLGISRAH | FSVMTPWAIA | YMGPSADAMI | NGSDGRTTVE | DLTTPPKWFP | 180
| FPTKVCWRKH | DLARLVPYKA | PGISDGYRMG | LVLKGSDCLL | SKCYHEFGTQ | WLPLLETLHQ | 240
| VPVVPVGLLP | PEIPGDEKDE | TWVSIKKWLD | GKQKGSVVYV | ALGSEVLVSQ | TEVVELALGL | 300
| ELSGLPFVWA | YRKPKGPAKS | DSVELPDGFV | ERTRDRGLVW | TSWAPQLRIL | SHESVCGFLT | 360
| HCGSGSIVEG | LMFGHPLIML | PIFGDQPLNA | RLLEDKQVGI | EIPRNEEDGC | LTKESVARSL | 420
| RSVVVEKEGE | IYKANARELS | KIYNDTKVEK | EYVSQFVDYL | EKNARAVAID | HES | 473

SEQ ID NO: 205

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWLPSI | AASLGISRAH | FSVTTPWKIA | YMGPSADAMI | NGSDGRTTVE | DLTTPPKWFP | 180
| FPTKVCWRKH | DLARLVPYKA | PGISDGYRMG | IVLKGSDCLL | SKCYHEFGTQ | WLPLLETLHQ | 240
| VPVVPVGLLP | PEIPGDEKDE | TWVSIKKWLD | GKQKGSVVYV | ALGSEVLVSQ | TEVVELALGL | 300
| ELSGLPFVWA | YRKPKGPAKS | DSVELPDGFV | ERTRDRGLVW | TSWAPQLRIL | SHESVCGFLT | 360
| HCGSGSIVEG | LMFGHPLIML | PIFGDQPLNA | RLLEDKQVGI | EIPRNEEDGC | LTKESVARSL | 420
| RSVVVEKEGE | IYKANARELS | KIYNDTKVEK | EYVSQFVDYL | EKNARAVAID | HES | 473

SEQ ID NO: 206

| | | | | | |
|---|---|---|---|---|---|
| MATSDSIVDD | RKQLHVATFP | WLAFGHILPY | LQLSKLIAEK | GHKVSFLSTT | RNIQRLSSHI | 60
| SPLINVVQLT | LPRVQELPED | AEATTDVHPE | DIPYLKKASD | GLQPEVTRFL | EQHSPDWIIY | 120
| DYTHYWLPSI | AASLGISRAH | FSVTTPWAIA | YMGPSADAMI | NGSDGRTTVE | DLTTPPKWFP | 180
| FPTKVCWRKH | DLARNVPYKA | PGISDGYRMG | LVLKGSDCLL | SKCYHEFGTQ | WLPLLETLHQ | 240
| VPVVPVGLLP | PEIPGDEKDE | TWVSIKKWLD | GKQKGSVVYV | ALGSEVLVSQ | TEVVELALGL | 300
| ELSGLPFVWA | YRKPKGPAKS | DSVELPDGFV | ERTRDRGLVW | TSWAPQLRIL | SHESVCGFLT | 360
| HCGSGSIVEG | LMFGHPLIML | PIFGDQPLNA | RLLEDKQVGI | EIPRNEEDGC | LTKESVARSL | 420
| RSVVVEKEGE | IYKANARELS | KIYNDTKVEK | EYVSQFVDYL | EKNARAVAID | HES | 473

TABLE 10-continued

Sequences disclosed herein.

SEQ ID NO: 207

```
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHSPDWIIY    120
DYTHYWLPSI AASLGISRAH FSVTTPWAIA YMGPSADAMI NGSDGRTTVE DLTTPPKWFP    180
FPTKVCWRKH DLARLVPYCA PGISDGYRMG LVLKGSDCLL SKCYHEFGTQ WLPLLETLHQ    240
VPVVPVGLLP PEIPGDEKDE TWVSIKKWLD GKQKGSVVYV ALGSEVLVSQ TEVVELALGL    300
ELSGLPFVWA YRKPKGPAKS DSVELPDGFV ERTRDRGLVW TSWAPQLRIL SHESVCGFLT    360
HCGSGSIVEG LMFGHPLIML PIFGDQPLNA RLLEDKQVGI EIPRNEEDGC LTKESVARSL    420
RSVVVEKEGE IYKANARELS KIYNDTKVEK EYVSQFVDYL EKNARAVAID HES           473
```

SEQ ID NO: 208

```
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHSPDWIIY    120
DYTHYWLPSI AASLGISRAH FSVTTPWAIA YMGPSADAMI NGSDGRTTVE DLTTPPKWFP    180
FPTKVCWRKH DLARLVPYKA PGISDGYRMG MVLKGSDCLL SKCYHEFGTQ WLPLLETLHQ    240
VPVVPVGLLP PEIPGDEKDE TWVSIKKWLD GKQKGSVVYV ALGSEVLVSQ TEVVELALGL    300
ELSGLPFVWA YRKPKGPAKS DSVELPDGFV ERTRDRGLVW TSWAPQLRIL SHESVCGFLT    360
HCGSGSIVEG LMFGHPLIML PIFGDQPLNA RLLEDKQVGI EIPRNEEDGC LTKESVARSL    420
RSVVVGKEGE IYKANARELS KIYNDTKVEK EYVSQFVDYL EKNARVVAID HES           473
```

SEQ ID NO: 209

```
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHSPDWIIY    120
DYTHYWLPSI AASLGISRAH FSVTTPWAIA YMGPSADAMI NGSDGRTTVE DLTTPPKWFP    180
FPTKVCWRKH DLARLVPYKA PGISDGYRMG TVLKGSDCLL SKCYHEFGTQ WLPLLETLHQ    240
VPVVPVGLLP PEIPGDEKDE TWVSIKKWLD GKQKGSVVYV ALGSEVLVSQ TEVVELALGL    300
ELSGLPFVWA YRKPKGPAKS DSVELPDGFV ERTRDRGLVW TSWAPQLRIL SHESVCGFLT    360
HCGSGSIVEG LMFGHPLIML PIFGDQPLNA RLLEDKQVGI EIPRNEEDGC LTKESVARSL    420
RSVVVEKEGE IYKANARELS KIYNDTKVEK EYVSQFVDYL EKNARAVAID HES           473
```

SEQ ID NO: 210

```
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHSPDWIIY    120
DYTHYWLPSI AASLGISRAH FSVTTPWAIA YMGPSADAMI NGSDGRTTVE DLTTPPKWFP    180
FPTKVCWRKH DLARLVPYKA PGISDGYRMG LVLKGSDCLL SKCYHEFGTQ WLPLLETLHQ    240
VPVVPVGLLP PEIPGDEKDE TWVSIKKWLD GKQKGSVVYV ALGSENLVSQ TEVVELALGL    300
ELSGLPFVWA YRKPKGPAKS DSVELPDGFV ERTRDRGLVW TSWAPQLRIL SHESVCGFLT    360
HCGSGSIVEG LMFGHPLIML PIFGDQPLNA RLLEDKQVGI EIPRNEEDGC LTKESVARSL    420
RSVVVEKEGE IYKANARELS KIYNDTKVEK EYVSQFVDYL EKNARAVAID HES           473
```

SEQ ID NO: 211

```
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHFPDWIIY    120
DYTHYWLPSI AASLGISRAH FSVTTPWAIA YMGPSADAMI NGSDGRTTVE DLTTPPKWFP    180
FPTKVCWRKH DLARLVPYKA PGISDGYRMG LVLKGSDCLL SKCYHEFGTQ WLPLLETLHQ    240
VPVVPVGLLP PEIPGDEKDE TWVSIKKWLD GKQKGSVVYV ALGSESLVSQ TEVVELALGL    300
ELSGLPFVWA YRKPKGPAKS DSVELPDGFV ERTRDRGLVW TSWAPQLRIL SHESVCGFLT    360
HCGSGSIVEG LMFGHPLIML PIFGDQPLNA RLLEDKQVGI EIPRNEEDGC LTKESVARSL    420
RSVVVEKEGE IYKANARELS KIYNDTKVEK EYVSQFVDYL EKNARAVAID HES           473
```

SEQ ID NO: 212

```
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHSPDWIIY    120
DYTHYWLPSI AASLGISRAH FSVTTPWAIA YMGPSADAMI NGSDGRTTVE DLTTPPKWFP    180
FPTKVCWRKH DLARLVPYKA PGISDGYRMG LVLKGSDCLL SKCYHEFGTQ WLPLLETLHQ    240
VPVVPVGLLP PEIPGDEKDE TWVSIKKWLD GKQKGSVVYV ALGSEVLVSQ TEVVELALGL    300
ELSGLPFVWA YRKPKGPAKS DSVELPDGFV ERTRDRGLVW TSWAPQLRIL SHESVCGFLT    360
HCGSGSIVEG LMFGHPLIML PIFKDQPLNA RLLEDKQVGI EIPRNEEDGC LTKESVARSL    420
RSVVVEKEGE IYKANARELS KIYNDTKVEK EYVSQFVDYL EKNARAVAID HES           473
```

SEQ ID NO: 213

```
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHSPDWIIY    120
DYTHYWLPSI AASLGISRAH FSVTTPWAIA YMGPSADAMI NGSDGRTTVE DLTTPPKWFP    180
FPTKVCWRKH DLARLVPYKA PGISDGYRMG LVLKGSDCLL SKCYHEFGTQ WLPLLETLHQ    240
VPVVPVGLLP PEIPGDEKDE TWVSIKKWLD GKQKGSVVYV ALGSEVLVSQ TEVVELALGL    300
ELSGLPFVWA YRKPKGPAKS DSVELPDGFV ERTRDRGLVW TSWAPQLRIL SHESVCGFLT    360
HCGSGSIVEG LMFGHPLIML PIFYDQPLNA RLLEDKQVGI EIPRNEEDGC LTKESVARSL    420
RSVVVEKEGE IYKANARELS KIYNDTKVEK EYVSQFVDYL EKNARAVAID HES           473
```

TABLE 10-continued

Sequences disclosed herein.

SEQ ID NO: 214

```
MATSDSIVDD RKQLHVATFP WLAFGHILPY LQLSKLIAEK GHKVSFLSTT RNIQRLSSHI      60
SPLINVVQLT LPRVQELPED AEATTDVHPE DIPYLKKASD GLQPEVTRFL EQHSPDWIIY     120
DYTHYWLPSI AASLGISRAH FSVTTPWAIA YMGPSADAMI NGSDGRTTVE DLTTPPKWFP     180
FPTKVCWRKH DLARLVPYKA PGISDGYRMG LVLKGSDCLL SKCYHEFGTQ WLPLLETLHQ     240
VPVVPVGLLP PEIPGDEKDE TWVSIKKWLD GKQKGSVVYV ALGSEVLVSQ TEVVELALGL     300
ELSGLPFVWA YRKPKGPAKS DSVELPDGFV ERTRDRGLVW TSWAPQLRIL SHESVCGFLT     360
HCGSGSIVEG LMFGHPLIML PIFGDQPLNA RLLEDKQVGI EIPRNEEDGC LTKESVARSL     420
RSVVVEKEGE IYKANARMLS KIYNDTKVEK EYVSQFVDYL EKNARAVAID HES            473
```

SEQ ID NO: 215

```
ATCAACGGUAAAATGGATGCTATGGCTACCACCG
```

SEQ ID NO: 216

```
CGTGCGAUTCAGTTTCTGGCCAAAACGGTGATT
```

SEQ ID NO: 217

```
MENKTETTVR RRRRIILFPV PFHGHINPIL QLANVLYSKG FSITIFHTNF NKPKTSNYPH      60
FTFRFILDND PQDERISNLP THGPLAGMRI PIINEHGADE LRRELELLML ASEEDEEVSC     120
LITDALWYFA QSVADSLNLR RLVLMTSSLF NFHALVSLPQ FDELGYLDPD DKTRLEEQAS     180
GFPMLKVKDI KSAYSNWQIL KEILGKMIKQ TKASSGVIWN SFKELEESEL ETVIREIPAP     240
SFLIPLPKHL TASSSSLLDH DRTVFQWLDQ QPPSSVLYVS FGSTSEVDEK DFLEIARGLV     300
DSKQSFLWVV RPGFVKGSTW VEPLPDGFLG ERGRIVKWVP QQEVLAHGAI GAFWTHSGWN     360
STLESVCEGV PMIFSDFGLD QPLNARYMSD VLKVGVYLEN GWERGEIANA IRRVMVDEEG     420
EYIRQNARVL KQKADVSLMK GGSSYESLES LVSYISSL                            458
```

SEQ ID NO: 218

```
MENKTETTVR RRRRIILFPV PFQGHINPIL QLANVLYSKG FSITIFHTNF NKPKTSNYPH      60
FTFRFILDND PQDERISNLP THGPLAGMRI PIINEHGADE LRRELELLML ASEEDEEVSC     120
LITDALWYFA QSVADSLNLR RLVLMGSSLF NFHALVSLPQ FDELGYLDPD DKTRLEEQAS     180
GFPMLKVKDI KSAYSNWQIL KEILGKMIKQ TKASSGVIWN SFKELEESEL ETVIREIPAP     240
SFLIPLPKHL TASSSSLLDH DRTVFQWLDQ QPPSSVLYVS FGSTSEVDEK DFLEIARGLV     300
DSKQSFLWVV RPGFVKGSTW VEPLPDGFLG ERGRIVKWVP QQEVLAHGAI GAFWTHSGWN     360
STLESVCEGV PMIFSDFGLD QPLNARYMSD VLKVGVYLEN GWERGEIANA IRRVMVDEEG     420
EYIRQNARVL KQKADVSLMK GGSSYESLES LVSYISSL                            458
```

SEQ ID NO: 219

```
MENKTETTVR RRRRIILFPV PFQGHINPIL QLANVLYSKG FSITIFHTNF NKPKTSNYPH      60
FTFRFILDND PQDERISNLP THGPLAGMRI PIINEHGADE LRRELELLML ASEEDEEVSC     120
LITDALWYFA QSVADSLNLR RLVLMTSSLF NFHALVSLPQ FDELGYLDPD DKTRLEEQAS     180
GFPMLKVKDI KSAYSNWQIL KEILGKMIKQ TKASSGVIWN SFKELEESEL ETVIREIPAP     240
SFLIPLPKHL TASSSSGLDH DRTVFQWLDQ QPPSSVLYVS FGSTSEVDEK DFLEIARGLV     300
DSKQSFLWVV RPGFVKGSTW VEPLPDGFLG ERGRIVKWVP QQEVLAHGAI GAFWTHSGWN     360
STLESVCEGV PMIFSDFGLD QPLNARYMSD VLKVGVYLEN GWERGEIANA IRRVMVDEEG     420
EYIRQNARVL KQKADVSLMK GGSSYESLES LVSYISSL                            458
```

SEQ ID NO: 220

```
MENKTETTVR RRRRIILFPV PFQGHINPIL QLANVLYSKG FSITIFHTNF NKPKTSNYPH      60
FTFRFILDND PQDERISNLP THGPLAGMRI PIINEHGADE LRRELELLML ASEEDEEVSC     120
LITDALWYFA QSVADSLNLR RLVLMTSSLF NFHALVSLPQ FDELGYLDPD DKTRLEEQAS     180
GFPMLKVKDI KSAYSNWQIL KEILGKMIKQ TKASSGVIWN SFKELEESEL ETVIREIPAP     240
SFLIPLPKHL TASSSSLLDH DRTVFQWLDQ QPPSSVLYVS FGNTSEVDEK DFLEIARGLV     300
DSKQSFLWVV RPGFVKGSTW VEPLPDGFLG ERGRIVKWVP QQEVLAHGAI GAFWTHSGWN     360
STLESVCEGV PMIFSDFGLD QPLNARYMSD VLKVGVYLEN GWERGEIANA IRRVMVDEEG     420
EYIRQNARVL KQKADVSLMK GGSSYESLES LVSYISSL                            458
```

SEQUENCE LISTING (220 sequences)

SEQ ID NO: 1 - protein, 473 aa, Artificial Sequence
  UGT91D2e V286C
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSECLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 2 - protein, 473 aa, Artificial Sequence
  UGT91D2e G384W
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFWDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 3 - DNA, 1383 bp, Stevia rebaudiana
atggcagagcaacaaaagatcaaaaagtcacctcacgtcttacttattccatttcctctgcaaggacatatcaacccattcatacaatttgggaaaagattgattagtaagggtgtaaagacaacactggtaaccactatccacactttgaattctactctgaaccactcaaatactactactacaagtatagaaattcaagctatatcagacggatgcgatgagggtggctttatgtctgccggtgaatcttacttggaaacattcaagcaagtgggatccaagtctctggccgatctaatcaaaaagttacagagtgaaggcaccacaattgacgccataatctacgattctatgacagagtgggttttagacgttgctatcgaatttggtattgatggaggttcctttttcacacaagcatgtgttgtgaattctctatactaccatgtgcataaagggttaatctctttaccattgggtgaaactgtttcagttccaggttttccagtgttacaacgttgggaaaccccattgatcttacaaaatcatgaacaaatacaatcaccttggtcccagatgttgtttggtcaattcgctaacatcgatcaagcaagatgggtctttactaattcattctataagttagaggaagaggtaattgaatggactaggaagatctggaatttgaaagtcattggtccaacattgccatcaatgtatttggacaaaagacttgatgatgataaagataatggtttcaatttgtacaaggctaatcatcacgaatgtatgaattggctggatgacaaaccaaaggaatcagttgtatatgttgctttcggctctcttgttaaacatggtccagaacaagttgaggagattacaagagcacttatagactctgacgtaaactttttgtgggtcattaagcacaaagaggaggggaaactgccagaaaacctttctgaagtgataaagaccggaaaaggtctaatcgttgcttggtgtaaacaattggatgttttagctcatgaatctgtaggctgttttgtaacacattgcggattcaactctacactagaagccatttccttaggcgtacctgtcgttgcaatgcctcagttctccgatcagacaaccaacgctaaacttttggacgaaatactaggggtgggtgtcagagttaaagcagacgagaatggtatcgtcagaagagggaacctagcttcatgtatcaaaatgatcatggaagaggaaagaggagttatcataaggaaaaacgcagttaagtggaaggatcttgcaaaggttgccgtccatgaaggcggctcttcagataatgatattgttgaatttgtgtccgaactaatcaaagcctaa

SEQ ID NO: 4 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 5 - DNA, 1586 bp, Stevia rebaudiana
atggatgcaatggctacaactgagaagaaaccacacgtcatcttcataccatttccagcacaaagccacattaaagccatgctcaaactagcacaacttctccaccacaaaggactccagataaccttcgtcaacaccgacttcatccacaaccagtttcttgaatcatcgggcccacattgtctagacggtgcaccgggtttccggttcgaaaccattccggatggtgtttctcacagtccggaagcgagcatcccaatcagagaatcactcttgagatccattgaaaccaacttcttggatcgtttcattgatcttgtaaccaaacttccggatcctccgacttgtattatctcagatgggttcttgtcggttttcacaattgacgctgcaaaaaagcttggaattccggtcatgatgtattggacacttgctgcctgtgggttcatgggtttttaccatattcattctctcattgagaaaggatttgcaccacttaaagatgcaagttacttgacaaatgggtatttggacaccgtcattgattgggttccgggaatggaaggcatccgtctcaaggatttcccgctggactggagcactgacctcaatgacaaagttttgatgttcactacggaagctcctcaaaggtcacacaaggtttcacatcatattttccacacgttcgatgagttggagcctagtattataaaaactttgtcattgaggtataatcacatttacaccatcggcccactgcaattacttcttgatcaaatacccgaagagaaaaagcaaactggaattacgagtctccatggatacagtttagtaaaagaagaaccagagtgtttccagtggcttcagtctaaagaaccaaattccgtcgtttatgtaaattttggaagtactacagtaatgtctttagaagacatgacggaatttggttggggacttgctaatagcaaccattatttcctttggatcatccgatcaaacttggtgataggggaaaatgcagttttgccccctgaacttgaggaacatataaagaaaagaggctttattgctagctggtgttcacaagaaaaggtcttgaagcacccttcggttggagggttcttgactcattgtgggtggggatcgaccatcgagagcttgtctgctggggtgccaatgatatgctggccttattcgtgggaccagctgaccaactgtaggtatatatgcaaagaatgggaggttgggctcgagatgggaaccaaagtgaaacgagatgaagtcaagaggcttgtacaagagttgatgggagaaggaggtcacaaaatgaggaacaaggctaaagattggaaagaaaaggctcgcattgcaatagctcctaacggttcatcttctttgaacatagacaaaatggtcaaggaaatcaccgtgctagcaagaaactagttacaaagttgtttcacattgtgctttctatttaagatgtaactttgttctaatttaatattgtctagatgtattgaaccataagtttagttggtctcaggaattgatttttaatgaaataatggtcattaggggtgagt

SEQ ID NO: 6 - DNA, 1446 bp, Artificial Sequence
  Codon-optimized UGT85C2
atggatgcaatggcaactactgagaaaaagcctcatgtgatcttcattccatttcctgcacaatctcacataaaggcaatgctaaagttagcacaactattacaccataagggattacagataactttcgtgaataccgacttcatccataatcaatttctggaatctagtggccctcattgtttggacggagccccagggtttagattcgaaacaattcctgacggtgtttcacattccccagaggcctccatcccaataagagagagtttactgaggtcaatagaaaccaactttttggatcgtttcattgacttggtcacaaaacttccagacccaccaacttgcataatctctgatggctttctgtcagtgtttactatcgacgctgccaaaaagttgggtatcccagttatgatgtactggactcttgctgcatgcggtttcatgggtttctatcacatccattctcttatcgaaaagggttttgctccactgaaagatgcatcatacttaaccaacggctacctggatactgttattgactgggtaccaggtatggaaggtataagacttaaagattttcctttggattggtctacagaccttaatgataaagtattgatgtttactacagaagctccacaaagatctcataaggtttcacatcatatctttcacacctttgatgaattggaaccatcaatcatcaaaaccttgtctctaagatacaatcatatctacactattggtccattacaattacttctagatcaaattcctgaagagaaaaagcaaactggtattacatccttacacggctactctttagtgaaagaggaaccagaatgttttcaatggctacaaagtaaagagcctaattctgtggtctacgtcaacttcggaagtacaacagtcatgtccttggaagatatgactgaatttggttggggccttgctaattcaaatcattactttctatggattatcaggtccaatttggtaataggggaaaacgccgtattacctccagaattggaggaacacatcaaaaagagaggtttcattgcttcctggtgttctcaggaaaaggtattgaaacatccttctgttggtggtttccttactcattgcggttggggctctacaatcgaatcactaagtgcaggagttccaatgatttgttggccatattcatgggaccaacttacaaattgtaggtatatctgtaaagagtgggaagttggattagaaatgggaacaaaggttaaacgtgatgaagtgaaaagattggttcaggagttgatgggggaaggtggccacaagatgagaaacaaggccaaagattggaaggaaaaagccagaattgctattgctcctaacgggtcatcctctctaaacattgataagatggtcaaagagattacagtcttagccagaaactaa

SEQ ID NO: 7 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 8 - DNA, 1377 bp, Artificial Sequence
  Codon-optimized UGT76G1
atggaaaacaagaccgaaacaacagttagacgtaggcgtagaatcattctgtttccagtaccttttcaagggcacatcaatccaatactacaactagccaacgttttgtactctaaaggtttttctattacaatctttcacaccaatttcaacaaaccaaaaacatccaattacccacatttcacattcagattcatacttgataatgatccacaagatgaacgtatttcaaacttacctacccacggtcctttagctggaatgagaattccaatcatcaatgaacatggtgccgatgagcttagaagagaattagagttacttatgttggcatccgaagaggacgaggaagtctcttgtctgattactgacgctctatggtactttgcccaatctgtggctgatagtttgaatttgaggagattggtactaatgacatccagtctgtttaactttcacgctcatgttagtttaccacaatttgacgaattgggatacttggaccctgatgacaagactaggttagaggaacaggcctctggttttcctatgttgaaagtcaaagatatcaagtctgcctattctaattggcaaatcttgaaagagatcttaggaaagatgatcaaacagacaaaggcttcatctggagtgatttggaacagtttcaaagagttagaagagtctgaattggagactgtaatcagagaaattccagcaccttcattcctgataccattaccaaaacatttgactgcttcctcttcctctttgttggatcatgacagaacagtttttcaatggttggaccaacaaccacctagttctgttttgtacgtgtcatttggtagtacttctgaagtcgatgaaaaggacttccttgaaatcgcaagaggcttagtcgatagtaagcagtcattcctttgggtcgtgcgtccaggtttcgtgaaaggctcaacatgggtcgaaccacttccagatggttttctaggcgaaagaggtagaatagtcaaatgggttcctcaacaggaagttttagctcatggcgctattggggcattctggactcattccggatggaattcaactttagaatcagtatgcgaaggggtacctatgatcttttcagattttggtcttgatcaaccactgaacgcaagatacatgtctgatgttttgaaagtgggtgtatatctagaaaatggctgggaaaggggtgaaatagctaatgcaataagacgtgttatggttgatgaagagggggagtatatcagacaaaacgcaagagtgctgaagcaaaaggccgacgtttctctaatgaagggaggctcttcatacgaatccttagaatctcttgtttcctacatttcatcactgtaa

SEQ ID NO: 9 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 10 - DNA, 1422 bp, Artificial Sequence
  Codon-optimized UGT91D2e
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcctaa

SEQ ID NO: 11 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 12 - DNA, 1422 bp, Artificial Sequence
  Codon-optimized UGT91D2e-b
atggctacttctgattccatcgttgacgatagaaagcaattgcatgttgctacttttccatggttggctttcggtcatattttgccatacttgcaattgtccaagttgattgctgaaaagggtcacaaggtttcattcttgtctaccaccagaaacatccaaagattgtcctctcatatctccccattgatcaacgttgttcaattgactttgccaagagtccaagaattgccagaagatgctgaagctactactgatgttcatccagaagatatcccttacttgaaaaaggcttccgatggtttacaaccagaagttactagattcttggaacaacattccccagattggatcatctacgattatactcattactggttgccatccattgctgcttcattgggtatttctagagcccatttctctgttactactccatgggctattgcttatatgggtccatctgctgatgctatgattaacggttctgatggtagaactaccgttgaagatttgactactccaccaaagtggtttccatttccaacaaaagtctgttggagaaaacacgatttggctagattggttccatacaaagctccaggtatttctgatggttacagaatgggtatggttttgaaaggttccgattgcttgttgtctaagtgctatcatgaattcggtactcaatggttgcctttgttggaaacattgcatcaagttccagttgttccagtaggtttgttgccaccagaaattccaggtgacgaaaaagacgaaacttgggtttccatcaaaaagtggttggatggtaagcaaaagggttctgttgtttatgttgctttgggttccgaagctttggtttctcaaaccgaagttgttgaattggctttgggtttggaattgtctggtttgccatttgtttgggcttacagaaaacctaaaggtccagctaagtctgattctgttgaattgccagatggtttcgttgaaagaactagagatagaggtttggtttggacttcttgggctccacaattgagaattttgtctcatgaatccgtctgtggtttcttgactcattgtggttctggttctatcgttgaaggtttgatgtttggtcacccattgattatgttgccaatctttggtgaccaaccattgaacgctagattattggaagataagcaagtcggtatcgaaatcccaagaaatgaagaagatggttgcttgaccaaagaatctgttgctagatctttgagatccgttgtcgttgaaaaagaaggtgaaatctacaaggctaacgctagagaattgtccaagatctacaacgataccaaggtcgaaaaagaatacgtttcccaattcgttgactacttggaaaagaatgctagagctgttgccattgatcatgaatcttga

SEQ ID NO: 13 - protein, 473 aa, Artificial Sequence
  UGT91D2e-b
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 14 - DNA, 1389 bp, Oryza sativa
atggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattga

SEQ ID NO: 15 - DNA, 1389 bp, Artificial Sequence
  Codon-optimized EUGT11
atggatagtggctactcctcatcttatgctgctgccgctggtatgcacgttgtgatctgcccttggttggcctttggtcacctgttaccatgtctggatttagcccaaagactggcctcaagaggccatagagtatcatttgtgtctactcctagaaatatctctcgtttaccaccagtcagacctgctctagctcctctagttgcattcgttgctcttccacttccaagagtagaaggattgccagacggcgctgaatctactaatgacgtaccacatgatagacctgacatggtcgaattgcatagaagagcctttgatggattggcagctccattttctgagttcctgggcacagcatgtgcagactgggttatagtcgatgtatttcatcactgggctgctgcagccgcattggaacataaggtgccttgtgctatgatgttgttagggtcagcacacatgatcgcatccatagctgatagaagattggaaagagctgaaacagaatccccagccgcagcaggacaaggtaggccagctgccgccccaacctttgaagtggctagaatgaaattgattcgtactaaaggtagttcagggatgagtcttgctgaaaggttttctctgacattatctagatcatcattagttgtaggtagatcctgcgtcgagttcgaacctgaaacagtacctttactatctactttgagaggcaaacctattactttccttggtctaatgcctccattacatgaaggaaggagagaagatggtgaagatgctactgttaggtggttagatgcccaacctgctaagtctgttgtttacgttgcattgggttctgaggtaccactaggggtggaaaaggtgcatgaattagcattaggacttgagctggccggaacaagattcctttgggctttgagaaaaccaaccggtgtttctgacgccgacttgctaccagctgggttcgaagagagaacaagaggccgtggtgtcgttgctactagatgggtcccacaaatgagtattctagctcatgcagctgtaggggcctttctaacccattgcggttggaactcaacaatagaaggactgatgtttggtcatccacttattatgttaccaatctttggcgatcagggacctaacgcaagattgattgaggcaaagaacgcaggtctgcaggttgcacgtaatgatggtgatggttcctttgatagagaaggcgttgcagctgccatcagagcagtcgccgttgaggaagagtcatctaaagttttccaagctaaggccaaaaaattacaagagattgtggctgacatggcttgtcacgaaagatacatcgatggtttcatccaacaattgagaagttataaagactaa

SEQ ID NO: 16 - protein, 462 aa, Oryza sativa
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 17 - protein, 465 aa, Artificial Sequence
  UGT91D2e-b-EUGT11 chimera 3
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIARNDGDGSFDREGVAAAIRAVAVEEESSKVFQAKAKKLQEIVADMACHERYIDGFIQQLRSYKD

SEQ ID NO: 18 - protein, 470 aa, Artificial Sequence
  UGT91D2e-b-EUGT11 chimera 7
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVPRNEEDGCLTKESVARSLRSVVVEKEGEIYKANARELSKIYNDTKVEKEYVSQFVDYLEKNARAVAIDHES

SEQ ID NO: 19 - DNA, 1086 bp, Artificial Sequence
  Codon-optimized GGPPS
atggctttggtaaacccaaccgctcttttctatggtacctctatcagaacaagacctacaaacttactaaatccaactcaaaagctaagaccagtttcatcatcttccttaccttctttctcatcagttagtgcgattcttactgaaaaacatcaatctaatccttctgagaacaacaatttgcaaactcatctagaaactcctttcaactttgatagttatatgttggaaaaagtcaacatggttaacgaggcgcttgatgcatctgtcccactaaaagacccaatcaaaatccatgaatccatgagatactctttattggcaggcggtaagagaatcagaccaatgatgtgtattgcagcctgcgaaatagtcggaggtaatatccttaacgccatgccagccgcatgtgccgtggaaatgattcatactatgtctttggtgcatgacgatcttccatgtatggataatgatgacttcagaagaggtaaacctatttcacacaaggtctacggggaggaaatggcagtattgaccggcgatgctttactaagtttatctttcgaacatatagctactgctacaaagggtgtatcaaaggatagaatcgtcagagctataggggagttggcccgttcagttggctccgaaggtttagtggctggacaagttgtagatatcttgtcagagggtgctgatgttggattagatcacctagaatacattcacatccacaaaacagcaatgttgcttgagtcctcagtagttattggcgctatcatgggaggaggatctgatcagcagatcgaaaagttgagaaaattcgctagatctattggtctactattccaagttgtggatgacattttggatgttacaaaatctaccgaagagttggggaaaacagctggtaaggatttgttgacagataagacaacttacccaaagttgttaggtatagaaaagtccagagaatttgccgaaaaacttaacaaggaagcacaagagcaattaagtggctttgatagacgtaaggcagctcctttgatcgcgttagccaactacaatgcgtaccgtcaaaattga

SEQ ID NO: 20 - protein, 361 aa, Stevia rebaudiana
MALVNPTALFYGTSIRTRPTNLLNPTQKLRPVSSSSLPSFSSVSAILTEKHQSNPSENNNLQTHLETPFNFDSYMLEKVNMVNEALDASVPLKDPIKIHESMRYSLLAGGKRIRPMMCIAACEIVGGNILNAMPAACAVEMIHTMSLVHDDLPCMDNDDFRRGKPISHKVYGEEMAVLTGDALLSLSFEHIATATKGVSKDRIVRAIGELARSVGSEGLVAGQVVDILSEGADVGLDHLEYIHIHKTAMLLESSVVIGAIMGGGSDQQIEKLRKFARSIGLLFQVVDDILDVTKSTEELGKTAGKDLLTDKTTYPKLLGIEKSREFAEKLNKEAQEQLSGFDRRKAAPLIALANYNAYRQN

SEQ ID NO: 21 - DNA, 1029 bp, Artificial Sequence
  Codon-optimized GGPPS
atggctgagcaacaaatatctaacttgctgtctatgtttgatgcttcacatgctagtcagaaattagaaattactgtccaaatgatggacacataccattacagagaaacgcctccagattcctcatcttctgaaggcggttcattgtctagatacgacgagagaagagtctctttgcctctcagtcataatgctgcctctccagatattgtatcacaactatgtttttccactgcaatgtcttcagagttgaatcacagatggaaatctcaaagattaaaggtggccgattctccttacaactatatcctaacattaccatcaaaaggaattagaggtgcctttatcgattccctgaacgtatggttggaggttccagaggatgaaacatcagtcatcaaggaagttattggtatgctccacaactcttcattaatcattgatgacttccaagataattctccacttagaagaggaaagccatctacccatacagtcttcggccctgcccaggctatcaatactgctacttacgttatagttaaagcaatcgaaaagatacaagacatagtgggacacgatgcattggcagatgttacgggtactattacaactattttccaaggtcaggccatggacttgtggtggacagcaaatgcaatcgttccatcaatacaggaatacttacttatggtaaacgataaaaccggtgctctctttagactgagtttggagttgttagctctgaattccgaagccagtatttctgactctgctttagaaagtttatctagtgctgtttccttgctaggtcaatacttccaaatcagagacgactatatgaacttgatcgataacaagtatacagatcagaaaggcttctgcgaagatcttgatgaaggcaagtactcactaacacttattcatgccctccaaactgattcatccgatctactgaccaacatcctttcaatgagaagagtgcaaggaaagttaacggcacaaaagagatgttggttctggaaatga

SEQ ID NO: 22 - protein, 342 aa, Gibberella fujikuroi
MAEQQISNLLSMFDASHASQKLEITVQMMDTYHYRETPPDSSSSEGGSLSRYDERRVSLPLSHNAASPDIVSQLCFSTAMSSELNHRWKSQRLKVADSPYNYILTLPSKGIRGAFIDSLNVWLEVPEDETSVIKEVIGMLHNSSLIIDDFQDNSPLRRGKPSTHTVFGPAQAINTATYVIVKAIEKIQDIVGHDALADVTGTITTIFQGQAMDLWWTANAIVPSIQEYLLMVNDKTGALFRLSLELLALNSEASISDSALESLSSAVSLLGQYFQIRDDYMNLIDNKYTDQKGFCEDLDEGKYSLTLIHALQTDSSDLLTNILSMRRVQGKLTAQKRCWFWK

SEQ ID NO: 23 - DNA, 903 bp, Artificial Sequence
  Codon-optimized GGPPS
atggaaaagactaaggagaaagcagaacgtatcttgctggagccatacagatacttattacaactaccaggaaagcaagtccgttctaaactatcacaagcgttcaatcactggttaaaagttcctgaagataagttacaaatcattattgaagtcacagaaatgctacacaatgcttctttactgatcgatgatatagaggattcttccaaactgagaagaggttttcctgtcgctcattccatatacggggtaccaagtgtaatcaactcagctaattacgtctacttcttgggattggaaaaagtattgacattagatcatccagacgctgtaaagctattcaccagacaacttcttgaattgcatcaaggtcaaggtttggatatctattggagagacacttatacttgcccaacagaagaggagtacaaagcaatggttctacaaaagactggcggtttgttcggacttgccgttggtctgatgcaacttttctctgattacaaggaggacttaaagcctctgttggataccttgggcttgtttttccagattagagatgactacgctaacttacattcaaaggaatattcagaaaacaaatcattctgtgaagatttgactgaagggaagtttagttttccaacaatccacgccatttggtcaagaccagaatctactcaagtgcaaaacattctgcgtcagagaacagagaatattgacatcaaaaagtattgtgttcagtacttggaagatgttggttcttttgcttacacaagacatacacttagagaattagaggcaaaagcatacaagcaaatagaagcctgtggaggcaatccttctctagtggcattggttaaacatttgtccaaaatgttcaccgaggaaaacaagtaa

SEQ ID NO: 24 - protein, 300 aa, Mus musculus
MEKTKEKAERILLEPYRYLLQLPGKQVRSKLSQAFNHWLKVPEDKLQIIIEVTEMLHNASLLIDDIEDSSKLRRGFPVAHSIYGVPSVINSANYVYFLGLEKVLTLDHPDAVKLFTRQLLELHQGQGLDIYWRDTYTCPTEEEYKAMVLQKTGGLFGLAVGLMQLFSDYKEDLKPLLDTLGLFFQIRDDYANLHSKEYSENKSFCEDLTEGKFSFPTIHAIWSRPESTQVQNILRQRTENIDIKKYCVQYLEDVGSFAYTRHTLRELEAKAYKQIEACGGNPSLVALVKHLSKMFTEENK

SEQ ID NO: 25 - DNA, 1020 bp, Artificial Sequence
  Codon-optimized GGPPS
atggcaagattctattttcttaacgcactattgatggttatctcattacaatcaactacagccttcactccagctaaacttgcttatccaacaacaacaacagctctaaatgtcgcctccgccgaaacttctttcagtctagatgaatacttggcctctaagataggacctatagagtctgccttggaagcatcagtcaaatccagaattccacagaccgataagatctgcgaatctatggcctactctttgatggcaggaggcaagagaattagaccagtgttgtgtatcgctgcatgtgagatgttcggtggatcccaagatgtcgctatgcctactgctgtggcattagaaatgatacacacaatgtctttgattcatgatgatttgccatccatggataacgatgacttgagaagaggtaaaccaacaaaccatgtcgttttcggcgaagatgtagctattcttgcaggtgactctttattgtcaacttccttcgagcacgtcgctagagaaacaaaaggagtgtcagcagaaaagatcgtggatgttatcgctagattaggcaaatctgttggtgccgagggccttgctggcggtcaagttatggacttagaatgtgaagctaaaccaggtaccacattagacgacttgaaatggattcatatccataaaaccgctacattgttacaagttgctgtagcttctggtgcagttctaggtggtgcaactcctgaagaggttgctgcatgcgagttgtttgctatgaatataggtcttgcctttcaagttgccgacgatatccttgatgtaaccgcttcatcagaagatttgggtaaaactgcaggcaaagatgaagctactgataagacaacttacccaaagttattaggattagaagagagtaaggcatacgcaagacaactaatcgatgaagccaaggaaagtttggctccttttggagatagagctgcccctttattggccattgcagatttcattattgatagaaagaattga

SEQ ID NO: 26 - protein, 339 aa, Thalassiosira pseudonana
MARFYFLNALLMVISLQSTTAFTPAKLAYPTTTTALNVASAETSFSLDEYLASKIGPIESALEASVKSRIPQTDKICESMAYSLMAGGKRIRPVLCIAACEMFGGSQDVAMPTAVALEMIHTMSLIHDDLPSMDNDDLRRGKPTNHVVFGEDVAILAGDSLLSTSFEHVARETKGVSAEKIVDVIARLGKSVGAEGLAGGQVMDLECEAKPGTTLDDLKWIHIHKTATLLQVAVASGAVLGGATPEEVAACELFAMNIGLAFQVADDILDVTASSEDLGKTAGKDEATDKTTYPKLLGLEESKAYARQLIDEAKESLAPFGDRAAPLLAIADFIIDRKN

SEQ ID NO: 27 - DNA, 1068 bp, Artificial Sequence
  Codon-optimized GGPPS
atgcacttagcaccacgtagagtccctagaggtagaagatcaccacctgacagagttcctgaaagacaaggtgccttgggtagaagacgtggagctggctctactggctgtgcccgtgctgctgctggtgttcaccgtagaagaggaggaggcgaggctgatccatcagctgctgtgcatagaggctggcaagccggtggtggcaccggtttgcctgatgaggtggtgtctaccgcagccgccttagaaatgtttcatgcttttgctttaatccatgatgatatcatggatgatagtgcaactagaagaggctccccaactgttcacagagccctagctgatcgtttaggcgctgctctggacccagatcaggccggtcaactaggagtttctactgctatcttggttggagatctggctttgacatggtccgatgaattgttatacgctccattgactccacatagactggcagcagtactaccattggtaacagctatgagagctgaaaccgttcatggccaatatcttgatataactagtgctagaagacctgggaccgatacttctcttgcattgagaatagccagatataagacagcagcttacacaatggaacgtccactgcacattggtgcagccctggctggggcaagaccagaactattagcagggctttcagcatacgccttgccagctggagaagccttccaattggcagatgacctgctaggcgtcttcggtgatccaagacgtacagggaaacctgacctagatgatcttagaggtggaaagcatactgtcttagtcgccttggcaagagaacatgccactccagaacagagacacacattggatacattattgggtacaccaggtcttgatagacaaggcgcttcaagactaagatgcgtattggtagcaactggtgcaagagccgaagccgaaagacttattacagagagaagagatcaagcattaactgcattgaacgcattaacactgccacctcctttagctgaggcattagcaagattgacattagggtctacagctcatcctgcctaa

SEQ ID NO: 28 - protein, 355 aa, Streptomyces clavuligerus
MHLAPRRVPRGRRSPPDRVPERQGALGRRRGAGSTGCARAAAGVHRRRGGGEADPSAAVHRGWQAGGGTGLPDEVVSTAAALEMFHAFALIHDDIMDDSATRRGSPTVHRALADRLGAALDPDQAGQLGVSTAILVGDLALTWSDELLYAPLTPHRLAAVLPLVTAMRAETVHGQYLDITSARRPGTDTSLALRIARYKTAAYTMERPLHIGAALAGARPELLAGLSAYALPAGEAFQLADDLLGVFGDPRRTGKPDLDDLRGGKHTVLVALAREHATPEQRHTLDTLLGTPGLDRQGASRLRCVLVATGARAEAERLITERRDQALTALNALTLPPPLAEALARLTLGSTAHPA

SEQ ID NO: 29 - DNA, 993 bp, Artificial Sequence
  Codon-optimized GGPPS
atgtcatatttcgataactacttcaatgagatagttaattccgtgaacgacatcattaagtcttacatctctggcgacgtaccaaaactatacgaagcctcctaccatttgtttacatcaggaggaaagagactaagaccattgatccttacaatttcttctgatcttttcggtggacagagagaaagagcatactatgctggcgcagcaatcgaagttttgcacacattcactttggttcacgatgatatcatggatcaagataacattcgtagaggtcttcctactgtacatgtcaagtatggcctacctttggccattttagctggtgacttattgcatgcaaaagcctttcaattgttgactcaggcattgagaggtctaccatctgaaactatcatcaaggcgtttgatatctttacaagatctatcattatcatatcagaaggtcaagctgtcgatatggaattcgaagatagaattgatatcaaggaacaagagtatttggatatgatatctcgtaaaaccgctgccttattctcagcttcttcttccattggggcgttgatagctggagctaatgataacgatgtgagattaatgtccgatttcggtacaaatcttgggatcgcatttcaaattgtagatgatatacttggtttaacagctgatgaaaaagagctaggaaaacctgttttcagtgatatcagagaaggtaaaaagaccatattagtcattaagactttagaattgtgtaaggaagacgagaaaaagattgtgttaaaagcgctaggcaacaagtcagcatcaaaggaagagttgatgagttctgctgacataatcaaaaagtactcattggattacgcctacaacttagctgagaaatactacaaaaacgccatcgattctctaaatcaagtttcaagtaaaagtgatattccagggaaggcattgaaatatcttgctgaattcaccatcagaagacgtaagtaa

SEQ ID NO: 30 - protein, 330 aa, Sulfolobus acidocaldarius
MSYFDNYFNEIVNSVNDIIKSYISGDVPKLYEASYHLFTSGGKRLRPLILTISSDLFGGQRERAYYAGAAIEVLHTFTLVHDDIMDQDNIRRGLPTVHVKYGLPLAILAGDLLHAKAFQLLTQALRGLPSETIIKAFDIFTRSIIIISEGQAVDMEFEDRIDIKEQEYLDMISRKTAALFSASSSIGALIAGANDNDVRLMSDFGTNLGIAFQIVDDILGLTADEKELGKPVFSDIREGKKTILVIKTLELCKEDEKKIVLKALGNKSASKEELMSSADIIKKYSLDYAYNLAEKYYKNAIDSLNQVSSKSDIPGKALKYLAEFTIRRRK

SEQ ID NO: 31 - DNA, 894 bp, Artificial Sequence
  Codon-optimized GGPPS
atggtcgcacaaactttcaacctggatacctacttatcccaaagacaacaacaagttgaagaggccctaagtgctgctcttgtgccagcttatcctgagagaatatacgaagctatgagatactccctcctggcaggtggcaaaagattaagacctatcttatgtttagctgcttgcgaattggcaggtggttctgttgaacaagccatgccaactgcgtgtgcacttgaaatgatccatacaatgtcactaattcatgatgacctgccagccatggataacgatgatttcagaagaggaaagccaactaatcacaaggtgttcggggaagatatagccatcttagcgggtgatgcgcttttagcttacgcttttgaacatattgcttctcaaacaagaggagtaccacctcaattggtgctacaagttattgctagaatcggacacgccgttgctgcaacaggcctcgttggaggccaagtcgtagaccttgaatctgaaggtaaagctatttccttagaaacattggagtatattcactcacataagactggagccttgctggaagcatcagttgtctcaggcggtattctcgcaggggcagatgaagagcttttggccagattgtctcattacgctagagatataggcttggcttttcaaatcgtcgatgatatcctggatgttactgctacatctgaacagttggggaaaaccgctggtaaagaccaggcagccgcaaaggcaacttatccaagtctattgggtttagaagcctctagacagaaagcggaagagttgattcaatctgctaaggaagccttaagaccttacggttcacaagcagagccactcctagcgctggcagacttcatcacacgtcgtcagcattaa

SEQ ID NO: 32 - protein, 297 aa, Synechococcus sp.
MVAQTFNLDTYLSQRQQQVEEALSAALVPAYPERIYEAMRYSLLAGGKRLRPILCLAACELAGGSVEQAMPTACALEMIHTMSLIHDDLPAMDNDDFRRGKPTNHKVFGEDIAILAGDALLAYAFEHIASQTRGVPPQLVLQVIARIGHAVAATGLVGGQVVDLESEGKAISLETLEYIHSHKTGALLEASVVSGGILAGADEELLARLSHYARDIGLAFQIVDDILDVTATSEQLGKTAGKDQAAAKATYPSLLGLEASRQKAEELIQSAKEALRPYGSQAEPLLALADFITRRQH

SEQ ID NO: 33 - DNA, 1680 bp, Artificial Sequence
  Codon-optimized CDPS
atgaaaaccgggtttatctcaccagcaacagtatttcatcacagaatctcaccagcgaccactttcagacatcacttatcacctgctactacaaactctacaggcattgtcgccttaagagacatcaacttcagatgtaaagcagtttctaaagagtactctgatctgttgcagaaagatgaggcttctttcacaaaatgggacgatgacaaggtgaaagatcatcttgataccaacaaaaacttatacccaaatgatgagattaaggaatttgttgaatcagtaaaggctatgttcggtagtatgaatgacggggagataaacgtctctgcatacgatactgcatgggttgctttggttcaagatgtcgatggatcaggtagtcctcagttcccttcttctttagaatggattgccaacaatcaattgtcagatggatcatggggagatcatttgctgttctcagctcacgatagaatcatcaacacattagcatgcgttattgcacttacaagttggaatgttcatccttctaagtgtgaaaaaggtttgaattttctgagagaaaacatttgcaaattagaagatgaaaacgcagaacatatgccaattggttttgaagtaacattcccatcactaattgatatcgcgaaaaagttgaacattgaagtacctgaggatactccagcacttaaagagatctacgcacgtagagatatcaagttaactaagatcccaatggaagttcttcacaaggtacctactactttgttacattctttggaaggaatgcctgatttggagtgggaaaaactgttaaagctacaatgtaaagatggtagtttcttgttttccccatctagtaccgcattcgccctaatgcaaacaaaagatgagaaatgcttacagtatctaacaaatatcgtcactaagttcaacggtggcgtgcctaatgtgtacccagtcgatttgtttgaacatatttgggttgttgatagactgcagagattggggattgccagatacttcaaatcagagataaaagattgtgtagagtatatcaataagtactggaccaaaaatggaatttgttgggctagaaatactcacgttcaagatatcgatgatacagccatgggattcagagtgttgagagcgcacggttatgacgtcactccagatgtttttagacaatttgaaaaagatggtaaattcgtttgctttgcagggcaatcaacacaagccgtgacaggaatgtttaacgtttacagagcctctcaaatgttgttcccaggggagagaattttggaagatgccaaaaagttctcttacaattacttaaaggaaaagcaaagtaccaacgaattgctggataaatggataatcgctaaagatctacctggtgaagttggttatgctctggatatcccatggtatgcttccttaccaagattggaaactcgttattaccttgaacaatacggcggtgaagatgatgtctggataggcaagacattatacagaatgggttacgtgtccaataacacatatctagaaatggcaaagctggattacaataactatgttgcagtccttcaattagaatggtacacaatacaacaatggtacgtcgatattggtatagagaagttcgaatctgacaacatcaagtcagtcctg

SEQ ID NO: 34 - protein, 787 aa, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 35 - DNA, 1584 bp, Artificial Sequence
  Codon-optimized CDPS
atgcctgatgcacacgatgctccacctccacaaataagacagagaacactagtagatgaggctacccaactgctaactgagtccgcagaagatgcatggggtgaagtcagtgtgtcagaatacgaaacagcaaggctagttgcccatgctacatggttaggtggacacgccacaagagtggccttccttctggagagacaacacgaagacgggtcatggggtccaccaggtggatataggttagtccctacattatctgctgttcacgcattattgacatgtcttgcctctcctgctcaggatcatggcgttccacatgatagacttttaagagctgttgacgcaggcttgactgccttgagaagattggggacatctgactccccacctgatactatagcagttgagctggttatcccatctttgctagagggcattcaacacttactggaccctgctcatcctcatagtagaccagccttctctcaacatagaggctctcttgtttgtcctggtggactagatgggagaactctaggagctttgagatcacacgccgcagcaggtacaccagtaccaggaaaagtctggcacgcttccgagactttgggcttgagtaccgaagctgcttctcacttgcaaccagcccaaggtataatcggtggctctgctgctgccacagcaacatggctaaccagggttgcaccatctcaacagtcagattctgccagaagataccttgaggaattacaacacagatactctggcccagttccttccattacccctatcacatacttcgaaagagcatggttattgaacaattttgcagcagccggtgttccttgtgaggctccagctgctttgttggattccttagaagcagcacttacaccacaaggtgctcctgctggagcaggattgcctccagatgctgatgatacagccgctgtgttgcttgcattggcaacacatgggagaggtagaagaccagaagtactgatggattacaggactgacgggtatttccaatgctttattggggaaaggactccatcaatttcaacaaacgctcacgtattggaaacattagggcatcatgtggcccaacatccacaagatagagccagatacggatcagccatggataccgcatcagcttggctgctggcagctcaaaagcaagatggctcttggttagataaatggcatgcctcaccatactacgctactgtttgttgcacacaagccctagccgctcatgcaagtcctgcaactgcaccagctagacagagagctgtcagatgggttttagccacacaaagatccgatggcggttggggtctatggcattcaactgttgaagagactgcttatgccttacagatcttggccccaccttctggtggtggcaatatcccagtccaacaagcacttactagaggcagagcaagattgtgtggagccttgccactgactcctttatggcatgataaggatttgtatactccagtaagagtagtcagagctgccagagctgctgctctgtacactaccagagatctattgttaccaccattgtaa

SEQ ID NO: 36 - protein, 527 aa, Streptomyces clavuligerus
MPDAHDAPPPQIRQRTLVDEATQLLTESAEDAWGEVSVSEYETARLVAHATWLGGHATRVAFLLERQHEDGSWGPPGGYRLVPTLSAVHALLTCLASPAQDHGVPHDRLLRAVDAGLTALRRLGTSDSPPDTIAVELVIPSLLEGIQHLLDPAHPHSRPAFSQHRGSLVCPGGLDGRTLGALRSHAAAGTPVPGKVWHASETLGLSTEAASHLQPAQGIIGGSAAATATWLTRVAPSQQSDSARRYLEELQHRYSGPVPSITPITYFERAWLLNNFAAAGVPCEAPAALLDSLEAALTPQGAPAGAGLPPDADDTAAVLLALATHGRGRRPEVLMDYRTDGYFQCFIGERTPSISTNAHVLETLGHHVAQHPQDRARYGSAMDTASAWLLAAQKQDGSWLDKWHASPYYATVCCTQALAAHASPATAPARQRAVRWVLATQRSDGGWGLWHSTVEETAYALQILAPPSGGGNIPVQQALTRGRARLCGALPLTPLWHDKDLYTPVRVVRAARAAALYTTRDLLLPPL

SEQ ID NO: 37 - DNA, 1551 bp, Artificial Sequence
  Codon-optimized CDPS
atgaacgccctatccgaacacattttgtctgaattgagaagattattgtctgaaatgagtgatggcggatctgttggtccatctgtgtatgatacggcccaggccctaagattccacggtaacgtaacaggtagacaagatgcatatgcttggttgatcgcccagcaacaagcagatggaggttggggctctgccgactttccactctttagacatgctccaacatgggctgcacttctcgcattacaaagagctgatccacttcctggcgcagcagacgcagttcagaccgcaacaagattcttgcaaagacaaccagatccatacgctcatgccgttcctgaggatgcccctattggtgctgaactgatcttgcctcagttttgtggagaggctgcttggttgttgggaggtgtggccttccctagacacccagccctattaccattaagacaggcttgtttagtcaaactgggtgcagtcgccatgttgccttcaggacacccattgctccactcctgggaggcatggggtacttctccaacaacagcctgtccagacgatgatggttctataggtatctcaccagcagctacagccgcctggagagcccaggctgtgaccagaggctcaactcctcaagtgggcagagctgacgcatacttacaaatggcttcaagagcaacgagatcaggcatagaaggagtcttccctaatgtttggcctataaacgtattcgaaccatgctggtcactgtacactctccatcttgccggtctgttcgcccatccagcactggctgaggctgtaagagttatcgttgctcaacttgaagcaagattgggagtgcatggcctcggaccagctttacattttgctgccgacgctgatgatactgcagttgccttatgcgttctgcatttggctggcagagatcctgcagttgacgcattgagacattttgaaattggtgagctctttgttacattcccaggagagagaaatgctagtgtctctacgaacattcacgctcttcatgctttgagattgttaggtaaaccagctgccggagcaagtgcatacgtcgaagcaaatagaaatccacatggtttgtgggacaacgaaaaatggcacgtttcatggctttatccaactgcacacgccgttgcagctctagctcaaggcaagcctcaatggagagatgaaagagcactagccgctctactacaagctcaaagagatgatggtggttggggagctggtagaggatccactttcgaggaaaccgcctacgctcttttcgctttacacgttatggacggatctgaggaagccacaggcagaagaagaatcgctcaagtcgtcgcaagagccttagaatggatgctagctagacatgccgcacatggattaccacaaacaccactctggattggtaaggaattgtactgtcctactagagtcgtaagagtagctgagctagctggcctgtggttagcattaagatggggtagaagagtattagctgaaggtgctggtgctgcaccttaa

SEQ ID NO: 38 - protein, 516 aa, Bradyrhizobium japonicum
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAAWLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLEARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 39 - DNA, 2490 bp, Artificial Sequence
  Codon-optimized CDPS
atggttttgtcttcttcttgtactacagtaccacacttatcttcattagctgtcgtgcaacttggtccttggagcagtaggattaaaaagaaaaccgatactgttgcagtaccagccgctgcaggaaggtggagaagggccttggctagagcacagcacacatcagaatccgcagctgtcgcaaagggcagcagtttgacccctatagtgagaactgacgctgagtcaaggagaacaagatggccaaccgatgacgatgacgccgaacctttagtggatgagatcagggcaatgcttacttccatgtctgatggtgacatttccgtgagcgcatacgatacagcctgggtcggattggttccaagattagacggcggtgaaggtcctcaatttccagcagctgtgagatggataagaaataaccagttgcctgacggaagttggggcgatgccgcattattctctgcctatgacaggcttatcaatacccttgcctgcgttgtaactttgacaaggtggtccctagaaccagagatgagaggtagaggactatcttttttgggtaggaacatgtggaaattagcaactgaagatgaagagtcaatgcctattggcttcgaattagcatttccatctttgatagagcttgctaagagcctaggtgtccatgacttcccttatgatcaccaggccctacaaggaatctactcttcaagagagatcaaaatgaagaggattccaaaagaagtgatgcataccgttccaacatcaatattgcacagtttggagggtatgcctggcctagattgggctaaactacttaaactacagagcagcgacggaagttttttgttctcaccagctgccactgcatatgctttaatgaataccggagatgacaggtgttttagctacatcgatagaacagtaaagaaattcaacggcggcgtccctaatgtttatccagtggatctatttgaacatatttgggccgttgatagacttgaaagattaggaatctccaggtacttccaaaaggagatcgaacaatgcatggattatgtaaacaggcattggactgaggacggtatttgttgggcaaggaactctgatgtcaaagaggtggacgacacagctatggcctttagacttcttaggttgcacggctacagcgtcagtcctgatgtgtttaaaaacttcgaaaaggacggtgaatttttcgcatttgtcggacagtctaatcaagctgttaccggtatgtacaacttaaacagagcaagccagatatccttcccaggcgaggatgtgcttcatagagctggtgccttctcatatgagttcttgaggagaaaagaagcagagggagctttgagggacaagtggatcatttctaaagatctacctggtgaagttgtgtatactttggattttccatggtacggcaacttacctagagtcgaggccagagactacctagagcaatacggaggtggtgatgacgtttggattggcaagacattgtataggatgccacttgtaaacaatgatgtatatttggaattggcaagaatggatttcaaccactgccaggctttgcatcagttagagtggcaaggactaaaaagatggtatactgaaaataggttgatggactttggtgtcgcccaagaagatgcccttagagcttattttcttgcagccgcatctgtttacgagccttgtagagctgccgagaggcttgcatgggctagagccgcaatactagctaacgccgtgagcacccacttaagaaatagcccatcattcagagaaaggttagagcattctcttaggtgtagacctagtgaagagacagatggctcctggtttaactcctcaagtggctctgatgcagttttagtaaaggctgtcttaagacttactgattcattagccagggaagcacagccaatccatggaggtgacccagaagatattatacacaagttgttaagatctgcttgggccgagtgggttagggaaaaggcagacgctgccgatagcgtgtgcaatggtagttctgcagtagaacaagagggatcaagaatggtccatgataaacagacctgtctattattggctagaatgatcgaaatttctgccggtagggcagctggtgaagcagccagtgaggacggcgatagaagaataattcaattaacaggctccatctgcgacagtcttaagcaaaaaatgctagtttcacaggaccctgaaaaaaatgaagagatgatgtctcacgtggatgacgaattgaagttgaggattagagagttcgttcaatatttgcttagactaggtgaaaaaaagactggatctagcgaaaccaggcaaacatttttaagtatagtgaaatcatgttactatgctgctcattgcccacctcatgtcgttgatagacacattagtagagtgattttcgagccagtaagtgccgcaaagtaaccgcgg

SEQ ID NO: 40 - protein, 827 aa, Zea mays
MVLSSSCTTVPHLSSLAVVQLGPWSSRIKKKTDTVAVPAAAGRWRRALARAQHTSESAAVAKGSSLTPIVRTDAESRRTRWPTDDDDAEPLVDEIRAMLTSMSDGDISVSAYDTAWVGLVPRLDGGEGPQFPAAVRWIRNNQLPDGSWGDAALFSAYDRLINTLACVVTLTRWSLEPEMRGRGLSFLGRNMWKLATEDEESMPIGFELAFPSLIELAKSLGVHDFPYDHQALQGIYSSREIKMKRIPKEVMHTVPTSILHSLEGMPGLDWAKLLKLQSSDGSFLFSPAATAYALMNTGDDRCFSYIDRTVKKFNGGVPNVYPVDLFEHIWAVDRLERLGISRYFQKEIEQCMDYVNRHWTEDGICWARNSDVKEVDDTAMAFRLLRLHGYSVSPDVFKNFEKDGEFFAFVGQSNQAVTGMYNLNRASQISFPGEDVLHRAGAFSYEFLRRKEAEGALRDKWIISKDLPGEVVYTLDFPWYGNLPRVEARDYLEQYGGGDDVWIGKTLYRMPLVNNDVYLELARMDFNHCQALHQLEWQGLKRWYTENRLMDFGVAQEDALRAYFLAAASVYEPCRAAERLAWARAAILANAVSTHLRNSPSFRERLEHSLRCRPSEETDGSWFNSSSGSDAVLVKAVLRLTDSLAREAQPIHGGDPEDIIHKLLRSAWAEWVREKADAADSVCNGSSAVEQEGSRMVHDKQTCLLLARMIEISAGRAAGEAASEDGDRRIIQLTGSICDSLKQKMLVSQDPEKNEEMMSHVDDELKLRIREFVQYLLRLGEKKTGSSETRQTFLSIVKSCYYAAHCPPHVVDRHISRVIFEPVSAAK

SEQ ID NO: 41 - DNA, 2570 bp, Artificial Sequence
  Codon-optimized CDPS
cttcttcactaaatacttagacagagaaaacagagctttttaaagccatgtctcttcagtatcatgttctaaactccattccaagtacaacctttctcagttctactaaaacaacaatatcttcttctttccttaccatctcaggatctcctctcaatgtcgctagagacaaatccagaagcggttccatacattgttcaaagcttcgaactcaagaatacattaattctcaagaggttcaacatgatttgcctctaatacatgagtggcaacagcttcaaggagaagatgctcctcagattagtgttggaagtaatagtaatgcattcaaagaagcagtgaagagtgtgaaaacgatcttgagaaacctaacggacggggaaattacgatatcggcttacgatacagcttgggttgcattgatcgatgccggagataaaactccggcgtttccctccgccgtgaaatggatcgccgagaaccaactttccgatggttcttggggagatgcgtatctcttctcttatcatgatcgtctcatcaatacccttgcatgcgtcgttgctctaagatcatggaatctctttcctcatcaatgcaacaaaggaatcacgtttttccgggaaaatattgggaagctagaagacgaaaatgatgagcatatgccaatcggattcgaagtagcattcccatcgttgcttgagatagctcgaggaataaacattgatgtaccgtacgattctccggtcttaaaagatatatacgccaagaaagagctaaagcttacaaggataccaaaagagataatgcacaagataccaacaacattgttgcatagtttggaggggatgcgtgatttagattgggaaaagctcttgaaacttcaatctcaagacggatctttcctcttctctccttcctctaccgcttttgcattcatgcagacccgagacagtaactgcctcgagtatttgcgaaatgccgtcaaacgtttcaatggaggagttcccaatgtctttcccgtggatcttttcgagcacatatggatagtggatcggttacaacgtttagggatatcgagatactttgaagaagagattaaagagtgtcttgactatgtccacagatattggaccgacaatggcatatgttgggctagatgttcccatgtccaagacatcgatgatacagccatggcatttaggctcttaagacaacatggataccaagtgtccgcagatgtattcaagaactttgagaaagagggagagtttttctgctttgtggggcaatcaaaccaagcagtaaccggtatgttcaacctataccgggcatcacaattggcgtttccaagggaagagatattgaaaaacgccaaagagttttcttataattatctgctagaaaaacgggagagagaggagttgattgataagtggattataatgaaagacttacctggcgagattgggtttgcgttagagattccatggtacgcaagcttgcctcgagtagagacgagattctatattgatcaatatggtggagaaaacgacgtttggattggcaagactctttataggatgccatacgtgaacaataatggatatctggaattagcaaaacaagattacaacaattgccaagctcagcatcagctcgaatgggacatattccaaaagtggtatgaagaaaataggttaagtgagtggggtgtgcgcagaagtgagcttctcgagtgttactacttagcggctgcaactatatttgaatcagaaaggtcacatgagagaatggtttgggctaagtcaagtgtattggttaaagccatttcttcttcttttggggaatcctctgactccagaagaagcttctccgatcagtttcatgaatacattgccaatgctcgacgaagtgatcatcactttaatgacaggaacatgagattggaccgaccaggatcggttcaggccagtcggcttgccggagtgttaatcgggactttgaatcaaatgtcttttgaccttttcatgtctcatggccgtgacgttaacaatctcctctatctatcgtggggagattggatggaaaaatggaaactatatggagatgaaggagaaggagagctcatggtgaagatgataattctaatgaagaacaatgacctaactaacttcttcacccacactcacttcgttcgtctcgcggaaatcatcaatcgaatctgtcttcctcgccaatacttaaaggcaaggagaaacgatgagaaggagaagacaataaagagtatggagaaggagatggggaaaatggttgagttagcattgtcggagagtgacacatttcgtgacgtcagcatcacgtttcttgatgtagcaaaagcattttactactttgctttatgtggcgatcatctccaaactcacatctccaaagtcttgtttcaaaaagtctagtaacctcatcatcatcatcgatccattaacaatcagtggatcgatgtatccatagatgcgtgaataatatttcatgtagagaaggagaacaaattagatcatgtagggttatca

SEQ ID NO: 42 - protein, 802 aa, Arabidopsis thaliana
MSLQYHVLNSIPSTTFLSSTKTTISSSFLTISGSPLNVARDKSRSGSIHCSKLRTQEYINSQEVQHDLPLIHEWQQLQGEDAPQISVGSNSNAFKEAVKSVKTILRNLTDGEITISAYDTAWVALIDAGDKTPAFPSAVKWIAENQLSDGSWGDAYLFSYHDRLINTLACVVALRSWNLFPHQCNKGITFFRENIGKLEDENDEHMPIGFEVAFPSLLEIARGINIDVPYDSPVLKDIYAKKELKLTRIPKEIMHKIPTTLLHSLEGMRDLDWEKLLKLQSQDGSFLFSPSSTAFAFMQTRDSNCLEYLRNAVKRFNGGVPNVFPVDLFEHIWIVDRLQRLGISRYFEEEIKECLDYVHRYWTDNGICWARCSHVQDIDDTAMAFRLLRQHGYQVSADVFKNFEKEGEFFCFVGQSNQAVTGMFNLYRASQLAFPREEILKNAKEFSYNYLLEKREREELIDKWIIMKDLPGEIGFALEIPWYASLPRVETRFYIDQYGGENDVWIGKTLYRMPYVNNNGYLELAKQDYNNCQAQHQLEWDIFQKWYEENRLSEWGVRRSELLECYYLAAATIFESERSHERMVWAKSSVLVKAISSSFGESSDSRRSFSDQFHEYIANARRSDHHFNDRNMRLDRPGSVQASRLAGVLIGTLNQMSFDLFMSHGRDVNNLLYLSWGDWMEKWKLYGDEGEGELMVKMIILMKNNDLTNFFTHTHFVRLAEIINRICLPRQYLKARRNDEKEKTIKSMEKEMGKMVELALSESDTFRDVSITFLDVAKAFYYFALCGDHLQTHISKVLFQKV

SEQ ID NO: 43 - DNA, 2355 bp, Artificial Sequence
  Codon-optimized KS
atgaatttgagtttgtgtatagcatctccactattgaccaaatctaatagaccagctgctttatcagcaattcatacagctagtacatcccatggtggccaaaccaaccctacgaatctgataatcgatacgaccaaggagagaatacaaaaacaattcaaaaatgttgaaatttcagtttcttcttatgatactgcgtgggttgccatggttccatcacctaattctccaaagtctccatgtttcccagaatgtttgaattggctgattaacaaccagttgaatgatggatcttggggtttagtcaatcacacgcacaatcacaaccatccacttttgaaagattctttatcctcaactttggcttgcatcgtggccctaaagagatggaacgtaggtgaggatcagattaacaaggggcttagtttcattgaatctaacttggcttccgcgactgaaaaatctcaaccatctccaataggattcgatatcatctttccaggtctgttagagtacgccaaaaatctagatatcaacttactgtctaagcaaactgatttctcactaatgttacacaagagagaattagaacaaaagagatgtcattcaaacgaaatggatggttacctagcttatatctctgaaggtcttggtaatctttacgattggaatatggtgaaaaagtaccagatgaaaaatggctcagttttcaattccccttctgcaactgcggcagcattcattaaccatcaaaatccaggatgcctgaactatttgaattcactactagacaaattcggcaacgcagttccaactgtataccctcacgatttgtttatcagattgagtatggtggatacaattgaaagacttggtatatcccaccactttagagtcgagatcaaaaatgttttggatgagacataccgttgttgggtggagagagatgaacaaatctttatggatgttgtgacgtgcgcgttggcctttagattgttgcgtattaacggttacgaagttagtccagatccacttgccgaaattacaaacgaattagctttaaaggatgaatacgccgctcttgaaacatatcatgcgtcacatatcctttaccaagaggacttatcatctggaaaacaaattcttaaatctgctgatttcctgaaggaaatcatatccactgatagtaatagactgtccaaactgatccataaagaggttgaaaatgcacttaagttccctattaacaccggcttagaacgtattaacacaagacgtaacatccagctttacaacgtagacaatactagaatcttgaaaaccacttaccattcttccaacatatcaaacactgattacctaagattagctgttgaagatttctacacatgtcagtctatctatagagaagagctgaaaggattagagagatgggtcgttgagaataagctagatcaattgaaatttgccagacaaaagacagcttattgttacttctcagttgccgccactttatcaagtccagaattgtcagatgcacgtatttcttgggctaaaaacggaattttgacaactgttgttgatgatttctttgatattggcgggacaatcgacgaattgacaaacctgattcaatgcgttgaaaagtggaatgtcgatgtcgataaagactgttgctcagaacatgttagaatactgttcttggctctgaaagatgctatctgttggatcggggatgaggctttcaaatggcaagctagagatgtgacgtctcacgtcattcaaacctggctagaactgatgaactctatgttgagagaagcaatttggactagagatgcatacgttcctacattaaacgagtatatggaaaacgcttatgtctcctttgctttgggtcctatcgttaagcctgccatatactttgtaggaccaaagctatccgaggaaatcgtcgaatcatcagaataccataacttgttcaagttaatgtccacacaaggcagattacttaatgatattcattctttcaaaagagagtttaaggaaggaaagttaaatgctgttgctctgcatctttctaatggcgaaagtggtaaagtcgaagaggaagtagttgaggaaatgatgatgatgatcaaaaacaagagaaaggagttgatgaaactaatcttcgaagagaacggttcaattgttcctagagcatgtaaggatgcattttggaacatgtgtcatgtgctaaactttttctacgcaaacgacgatggttttactgggaacacaatactagatacagtaaaagacatcatatacaaccctttggtcttagtaaacgaaaacgaggagcaaagataa

SEQ ID NO: 44 - protein, 784 aa, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 45 - DNA, 2355 bp, Artificial Sequence
  Codon-optimized KS
atgaatctgtccctttgtatagctagtccactgttgacaaaatcttctagaccaactgctctttctgcaattcatactgccagtactagtcatggaggtcaaacaaacccaacaaatttgataatcgatactactaaggagagaatccaaaagctattcaaaaatgttgaaatctcagtatcatcttatgacaccgcatgggttgcaatggtgccatcacctaattccccaaaaagtccatgttttccagagtgcttgaattggttaatcaataatcagttaaacgatggttcttggggtttagtcaaccacactcataaccacaatcatccattattgaaggactctttatcatcaacattagcctgtattgttgcattgaaaagatggaatgtaggtgaagatcaaatcaacaagggtttatcattcatagaatccaatctagcttctgctaccgacaaatcacaaccatctccaatcgggttcgacataatcttccctggtttgctggagtatgccaaaaaccttgatatcaacttactgtctaaacaaacagatttctctttgatgctacacaaaagagagttagagcagaaaagatgccattctaacgaaattgacgggtacttagcatatatctcagaaggtttgggtaatttgtatgactggaacatggtcaaaaagtatcagatgaaaaatggatccgtattcaattctccttctgcaactgccgcagcattcattaatcatcaaaaccctgggtgtcttaactacttgaactcactattagataagtttggaaatgcagttccaacagtctatcctttggacttgtacatcagattatctatggttgacactatagagagattaggtatttctcatcatttcagagttgagatcaaaaatgttttggacgagacatacagatgttgggtcgaaagagatgagcaaatctttatggatgtcgtgacctgcgctctggcttttagattgctaaggatacacggatacaaagtatctcctgatcaactggctgagattacaaacgaactggctttcaaagacgaatacgccgcattagaaacataccatgcatcccaaatactttaccaggaagacctaagttcaggaaaacaaatcttgaagtctgcagatttcctgaaaggcattctgtctacagatagtaataggttgtctaaattgatacacaaggaagtagaaaacgcactaaagtttcctattaacactggtttagagagaatcaatactaggagaaacattcagctgtacaacgtagataatacaaggattcttaagaccacctaccatagttcaaacatttccaacacctattacttaagattagctgtcgaagacttttacacttgtcaatcaatctacagagaggagttaaagggcctagaaagatgggtagttcaaaacaagttggatcaactgaagtttgctagacagaagacagcatactgttatttctctgttgctgctaccctttcatccccagaattgtctgatgccagaataagttgggccaaaaatggtattcttacaactgtagtcgatgatttctttgatattggaggtactattgatgaactgacaaatcttattcaatgtgttgaaaagtggaacgtggatgtagataaggattgctgcagtgaacatgtgagaatacttttcctggctctaaaagatgcaatatgttggattggcgacgaggccttcaagtggcaagctagagatgttacatctcatgtcatccaaacttggcttgaactgatgaactcaatgctaagagaagcaatctggacaagagatgcatacgttccaacattgaacgaatacatggaaaacgcttacgtctcatttgccttgggtcctattgttaagccagccatatactttgttgggccaaagttatccgaagagattgttgagtcttccgaatatcataacctattcaagttaatgtcaacacaaggcagacttctgaacgatatccactccttcaaaagagaattcaaggaaggtaagctaaacgctgttgctttgcacttgtctaatggtgaatctggcaaagtggaagaggaagtcgttgaggaaatgatgatgatgatcaaaaacaagagaaaggaattgatgaaattgattttcgaggaaaatggttcaatcgtacctagagcttgtaaagatgctttttggaatatgtgccatgttcttaacttcttttacgctaatgatgatggcttcactggaaatacaatattggatacagttaaagatatcatctacaacccacttgttttggtcaatgagaacgaggaacaaagataa

SEQ ID NO: 46 - protein, 784 aa, Stevia rebaudiana
MNLSLCIASPLLTKSSRPTALSAIHTASTSHGGQTNPTNLIIDTTKERIQKLFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATDKSQPSPIGFDIIFPGLLEYAKNLDINLLSKQTDFSLMLHKRELEQKRCHSNEIDGYLAYISEGLGNLYDWNMVKKYQMKNGSVFNSPSATAAAFINHQNPGCLNYLNSLLDKFGNAVPTVYPLDLYIRLSMVDTIERLGISHHFRVEIKNVLDETYRCWVERDEQIFMDVVTCALAFRLLRIHGYKVSPDQLAEITNELAFKDEYAALETYHASQILYQEDLSSGKQILKSADFLKGILSTDSNRLSKLIHKEVENALKFPINTGLERINTRRNIQLYNVDNTRILKTTYHSSNISNTYYLRLAVEDFYTCQSIYREELKGLERWVVQNKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 47 - DNA, 1773 bp, Artificial Sequence
  Codon-optimized KS
atggctatgccagtgaagctaacacctgcgtcattatccttaaaagctgtgtgctgcagattctcatccggtggccatgctttgagattcgggagtagtctgccatgttggagaaggacccctacccaaagatctacttcttcctctactactagaccagctgccgaagtgtcatcaggtaagagtaaacaacatgatcaggaagctagtgaagcgactatcagacaacaattacaacttgtggatgtcctggagaatatgggaatatccagacattttgctgcagagataaagtgcatactagacagaacttacagatcttggttacaaagacacgaggaaatcatgctggacactatgacatgtgctatggcttttagaatcctaagattgaacggatacaacgtttcatcagatgaactataccacgttgtagaggcatctggtctgcataattctttgggtgggtatcttaacgataccagaacactacttgaattacacaaggcttcaacagttagtatctctgaggatgaatctatcttagattcaattggctctagatccagaacattgcttagagaacaattggagtctggtggcgcactgagaaagccttctttattcaaagaggttgaacatgcactggatggacctttttacaccacacttgatagacttcatcataggtggaatattgaaaacttcaacattattgagcaacacatgttggagactccatacttatctaaccagcatacatcaagggatatcctagcattgtcaattagagatttttcctcctcacaattcacttatcaacaagagctacagcatctggagagttgggttaaggaatgtagattagatcaactacagttcgcaagacagaaattagcgtacttttacctatcagccgcaggcaccatgttttctcctgagctttctgatgcgagaacattatgggccaaaaacggggtgttgacaactattgttgatgatttctttgatgttgccggttctaaagaggaattggaaaacttagtcatgctggtcgaaatgtgggatgaacatcacaaagttgaattctattctgagcaggtcgaaatcatcttctcttccatctacgattctgtcaaccaattgggtgagaaggcctctttggttcaagacagatcaattacaaaacaccttgttgaaatatggttagacttgttaaagtccatgatgacggaagttgaatggagactgtcaaaatacgtgcctacagaaaaggaatacatgattaatgcctctcttatcttcggcctaggtccaatcgttttaccagctttgtatttcgttggtccaaagatttcagaaagtatagtaaaggacccagaatatgatgaattgttcaaactaatgtcaacatgtggtagattgttgaatgacgtgcaaacgttcgaaagagaatacaatgagggtaaactgaattctgtcagtctattggttcttcacggaggcccaatgtctatttcagacgcaaagaggaaattacaaaagcctattgatacgtgtagaagagatcttctttctttggtccttagagaagagtctgtagtaccaagaccatgtaaggaactattctggaaaatgtgtaaagtgtgctatttcttttactcaacaactgatgggttttctagtcaagtcgaaagagcaaaagaggtagacgctgtcataaatgagccactgaagttgcaaggttctcatacactggtatctgatgtttaa

SEQ ID NO: 48 - protein, 590 aa, Zea mays
MAMPVKLTPASLSLKAVCCRFSSGGHALRFGSSLPCWRRTPTQRSTSSSTTRPAAEVSSGKSKQHDQEASEATIRQQLQLVDVLENMGISRHFAAEIKCILDRTYRSWLQRHEEIMLDTMTCAMAFRILRLNGYNVSSDELYHVVEASGLHNSLGGYLNDTRTLLELHKASTVSISEDESILDSIGSRSRTLLREQLESGGALRKPSLFKEVEHALDGPFYTTLDRLHHRWNIENFNIIEQHMLETPYLSNQHTSRDILALSIRDFSSSQFTYQQELQHLESWVKECRLDQLQFARQKLAYFYLSAAGTMFSPELSDARTLWAKNGVLTTIVDDFFDVAGSKEELENLVMLVEMWDEHHKVEFYSEQVEIIFSSIYDSVNQLGEKASLVQDRSITKHLVEIWLDLLKSMMTEVEWRLSKYVPTEKEYMINASLIFGLGPIVLPALYFVGPKISESIVKDPEYDELFKLMSTCGRLLNDVQTFEREYNEGKLNSVSLLVLHGGPMSISDAKRKLQKPIDTCRRDLLSLVLREESVVPRPCKELFWKMCKVCYFFYSTTDGFSSQVERAKEVDAVINEPLKLQGSHTLVSDV

SEQ ID NO: 49 - DNA, 2232 bp, Artificial Sequence
  Codon-optimized KS
atgcagaacttccatggtacaaaggaaaggatcaaaaagatgtttgacaagattgaattgtccgtttcttcttatgatacagcctgggttgcaatggtcccatcccctgattgcccagaaacaccttgttttccagaatgtactaaatggatcctagaaaatcagttgggtgatggtagttggtcacttcctcatggcaatccacttctagttaaagatgcattatcttccactcttgcttgtattctggctcttaaaagatggggaatcggtgaggaacagattaacaaaggactgagattcatagaactcaactctgctagtgtaaccgataacgaacaacacaaaccaattggatttgacattatctttccaggtatgattgaatacgctatagacttagacctgaatctaccactaaaaccaactgacattaactccatgttgcatcgtagagcccttgaattgacatcaggtggaggcaaaaatctagaaggtagaagagcttacttggcctacgtctctgaaggaatcggtaagctgcaagattgggaaatggctatgaaataccaacgtaaaaacggatctctgttcaatagtccatcaacaactgcagctgcattcatccatatacaagatgctgaatgcctccactatattcgttctcttctccagaaatttggaaacgcagtccctacaatataccctctcgatatctatgccagactttcaatggtagatgccctggaacgtcttggtattgatagacatttcagaaaggagagaaagttcgttctggatgaaacatacagattttggttgcaaggagaagaggagattttctccgataacgcaacctgtgctttggccttcagaatattgagacttaatggttacgatgtctctcttgaagatcacttctctaactctctgggcggttacttaaaggactcaggagcagctttagaactgtacagagccctccaattgtcttacccagacgagtccctcctggaaaagcaaaattctagaacttcttacttcttaaaacaaggtttatccaatgtctccctctgtggtgacagattgcgtaaaaacataattggagaggtgcatgatgctttaaacttttccgaccacgctaacttacaaagattagctattcgtagaaggattaagcattacgctactgacgatacaaggattctaaaaacttcctacagatgctcaacaatcggtaaccaagattttctaaaacttgcagtggaagatttcaatatctgtcaatcaatacaaagagaggaattcaagcatattgaaagatgggtcgttgaaagacgtctagacaagttaaagttcgctagacaaaaagaggcctattgctatttctcagccgcagcaacattgtttgcccctgaattgtctgatgctagaatgtcttgggccaaaaatggtgtattgacaactgtggttgatgatttcttcgatgtcggaggctctgaagaggaattagttaacttgatagaattgatcgagcgttgggatgtgaatggcagtgcagatttttgtagtgaggaagttgagattatctattctgctatccactcaactatctctgaaataggtgataagtcatttggctggcaaggtagagatgtaaagtctcaagttatcaagatctggctggacttattgaaatcaatgttaactgaagctcaatggtcttcaaacaagtctgttcctaccctagatgagtatatgacaaccgcccatgtttcattcgcacttggtccaattgtacttccagccttatacttcgttggcccaaagttgtcagaagaggttgcaggtcatcctgaactactaaacctctacaaagtcacatctacttgtggcagactactgaatgattggagaagttttaagagagaatccgaggaaggtaagctcaacgctattagtttatacatgatccactccggtggtgcttctacagaagaggaaacaatcgaacatttcaaaggtttgattgattctcagagaaggcaactgttacaattggtgttgcaagagaaggatagtatcatacctagaccatgtaaagatctattttggaatatgattaagttattacacactttctacatgaaagatgatggcttcacctcaaatgagatgaggaatgtagttaaggcaatcattaacgaaccaatctcactggatgaattatga

SEQ ID NO: 50 - protein, 775 aa, Populus trichocarpa
MSCIRPWFCPSSISATLTDPASKLVTGEFKTTSLNFHGTKERIKKMFDKIELSVSSYDTAWVAMVPSPDCPETPCFPECTKWILENQLGDGSWSLPHGNPLLVKDALSSTLACILALKRWGIGEEQINKGLRFIELNSASVTDNEQHKPIGFDIIFPGMIEYAKDLDLNLPLKPTDINSMLHRRALELTSGGGKNLEGRRAYLAYVSEGIGKLQDWEMAMKYQRKNGSLFNSPSTTAAAFIHIQDAECLHYIRSLLQKFGNAVPTIYPLDIYARLSMVDALERLGIDRHFRKERKFVLDETYRFWLQGEEEIFSDNATCALAFRILRLNGYDVSLEDHFSNSLGGYLKDSGAALELYRALQLSYPDESLLEKQNSRTSYFLKQGLSNVSLCGDRLRKNIIGEVHDALNFPDHANLQRLAIRRRIKHYATDDTRILKTSYRCSTIGNQDFLKLAVEDFNICQSIQREEFKHIERWVVERRLDKLKFARQKEAYCYFSAAATLFAPELSDARMSWAKNGVLTTVVDDFFDVGGSEEELVNLIELIERWDVNGSADFCSEEVEIIYSAIHSTISEIGDKSFGWQGRDVKSHVIKIWLDLLKSMLTEAQWSSNKSVPTLDEYMTTAHVSFALGPIVLPALYFVGPKLSEEVAGHPELLNLYKVMSTCGRLLNDWRSFKRESEEGKLNAISLYMIHSGGASTEEETIEHFKGLIDSQRRQLLQLVLQEKDSIIPRPCKDLFWNMIKLLHTFYMKDDGFTSNEMRNVVKAIINEPISLDEL

SEQ ID NO: 51 - DNA, 2358 bp, Artificial Sequence
  Codon-optimized KS
atgtctatcaaccttcgctcctccggttgttcgtctccgatctcagctactttggaacgaggattggactcagaagtacagacaagagctaacaatgtgagctttgagcaaacaaaggagaagattaggaagatgttggagaaagtggagctttctgtttcggcctacgatactagttgggtagcaatggttccatcaccgagctcccaaaatgctccacttttcccacagtgtgtgaaatggttattggataatcaacatgaagatggatcttggggacttgataaccatgaccatcaatctcttaagaaggatgtgttatcatctacactggctagtatcctcgcgttaaagaagtggggaattggtgaaagacaaataaacaagggtctccagtttattgagctgaattctgcattagtcactgatgaaaccatacagaaaccaacagggtttgatattatatttcctgggatgattaaatatgctagagatttgaatctgacgattccattgggctcagaagtggtggatgacatgatacgaaaaagagatctggatcttaaatgtgatagtgaaaagttttcaaagggaagagaagcatatctggcctatgttttagaggggacaagaaacctaaaagattgggatttgatagtcaaatatcaaaggaaaaatgggtcactgtttgattctccagccacaacagcagctgcttttactcagtttgggaatgatggttgtctccgttatctctgttctctccttcagaaattcgaggctgcagttccttcagtttatccatttgatcaatatgcacgccttagtataattgtcactcttgaaagcttaggaattgatagagatttcaaaaccgaaatcaaaagcatattggatgaaacctatagatattggcttcgtggggatgaagaaatatgtttggacttggccacttgtgctttggctttccgattattgcttgctcatggctatgatgtgtcttacgatccgctaaaaccatttgcagaagaatctggtttctctgatactttggaaggatatgttaagaatacgttttctgtgttagaattatttaaggctgctcaaagttatccacatgaatcagctttgaagaagcagtgttgttggactaaacaatatctggagatggaattgtccagctgggttaagacctctgttcgagataaatacctcaagaaagaggtcgaggatgctcttgcttttccctcctatgcaagcctagaaagatcagatcacaggagaaaaatactcaatggttctgctgtggaaaacaccagagttacaaaaacctcatatcgtttgcacaatatttgcacctctgatatcctgaagttagctgtggatgacttcaatttctgccagtccatacaccgtgaagaaatggaacgtcttgataggtggattgtggagaatagattgcaggaactgaaatttgccagacagaagctggcttactgttatttctctggggctgcaactttattttctccagaactatctgatgctcgtatatcgtgggccaaaggtggagtacttacaacggttgtagacgacttctttgatgttggagggtccaaagaagaactggaaaacctcatacacttggtcgaaaagtgggatttgaacggtgttcctgagtacagctcagaacatgttgagatcatattctcagttctaagggacaccattctcgaaacaggagacaaagcattcacctatcaaggacgcaatgtgacacaccacattgtgaaaatttggttggatctgctcaagtctatgttgagagaagccgagtggtccagtgacaagtcaacaccaagcttggaggattacatggaaaatgcgtacatatcatttgcattaggaccaattgtcctcccagctacctatctgatcggacctccacttccagagaagacagtcgatagccaccaatataatcagctctacaagctcgtgagcactatgggtcgtcttctaaatgacatacaaggttttaagagagaaagcgcggaagggaagctgaatgcggtttcattgcacatgaaacacgagagagacaatcgcagcaaagaagtgatcatagaatcgatgaaaggtttagcagagagaaagagggaagaattgcataagctagttttggaggagaaaggaagtgtggttccaagggaatgcaaagaagcgttcttgaaaatgagcaaagtgttgaacttattttacaggaaggacgatggattcacatcaaatgatctgatgagtcttgttaaatcagtgatctacgagcctgttagcttacagaaagaatctttaacttga

SEQ ID NO: 52 - protein, 785 aa, Arabidopsis thaliana
MSINLRSSGCSSPISATLERGLDSEVQTRANNVSFEQTKEKIRKMLEKVELSVSAYDTSWVAMVPSPSSQNAPLFPQCVKWLLDNQHEDGSWGLDNHDHQSLKKDVLSSTLASILALKKWGIGERQINKGLQFIELNSALVTDETIQKPTGFDIIFPGMIKYARDLNLTIPLGSEVVDDMIRKRDLDLKCDSEKFSKGREAYLAYVLEGTRNLKDWDLIVKYQRKNGSLFDSPATTAAAFTQFGNDGCLRYLCSLLQKFEAAVPSVYPFDQYARLSIIVTLESLGIDRDFKTEIKSILDETYRYWLRGDEEICLDLATCALAFRLLLAHGYDVSYDPLKPFAEESGFSDTLEGYVKNTFSVLELFKAAQSYPHESALKKQCCWTKQYLEMELSSWVKTSVRDKYLKKEVEDALAFPSYASLERSDHRRKILNGSAVENTRVTKTSYRLHNICTSDILKLAVDDFNFCQSIHREEMERLDRWIVENRLQELKFARQKLAYCYFSGAATLFSPELSDARISWAKGGVLTTVVDDFFDVGGSKEELENLIHLVEKWDLNGVPEYSSEHVEIIFSVLRDTILETGDKAFTYQGRNVTHHIVKIWLDLLKSMLREAEWSSDKSTPSLEDYMENAYISFALGPIVLPATYLIGPPLPEKTVDSHQYNQLYKLVSTMGRLLNDIQGFKRESAEGKLNAVSLHMKHERDNRSKEVIIESMKGLAERKREELHKLVLEEKGSVVPRECKEAFLKMSKVLNLFYRKDDGFTSNDLMSLVKSVIYEPVSLQKESLT

SEQ ID NO: 53 - DNA, 2952 bp, Artificial Sequence
  Codon-optimized CDPS-KS
atggaatttgatgaaccattggttgacgaagcaagatctttagtgcagcgtactttacaagattatgatgacagatacggcttcggtactatgtcatgtgctgcttatgatacagcctgggtgtctttagttacaaaaacagtcgatgggagaaaacaatggcttttcccagagtgttttgaatttctactagaaacacaatctgatgccggaggatgggaaatcgggaattcagcaccaatcgacggtatattgaatacagctgcatccttacttgctctaaaacgtcacgttcaaactgagcaaatcatccaacctcaacatgaccataaggatctagcaggtagagctgaacgtgccgctgcatctttgagagcacaattggctgcattggatgtgtctacaactgaacacgtcggttttgagataattgttcctgcaatgctagacccattagaagccgaagatccatctctagttttcgattttccagctaggaaacctttgatgaagattcatgatgctaagatgagtagattcaggccagaatacttgtatggcaaacaaccaatgaccgccttacattcattagaggctttcataggcaaaatcgacttcgataaggtaagacaccaccgtacccatgggtctatgatgggttctccttcatctaccgcagcctacttaatgcacgcttcacaatgggatggtgactcagaggcttaccttagacacgtgattaaacacgcagcagggcagggaactggtgctgtaccatctgctttcccatcaacacattttgagtcatcttggattcttaccacattgtttagagctggattttcagcttctcatcttgcctgtgatgagttgaacaagttggtcgagatacttgagggctcattcgagaaggaaggtggggcaatcggttacgctccagggtttcaagcagatgttgatgatactgctaaaacaataagtacattagcagtccttggaagagatgctacaccaagacaaatgatcaaggtatttgaagctaatacacattttagaacataccctggtgaaagagatccttctttgacagctaattgtaatgctctatcagccttactacaccaaccagatgcagcaatgtatggatctcaaattcaaaagattaccaaatttgtctgtgactattggtggaagtctgatggtaagattaaagataagtggaacacttgctacttgtacccatctgtcttattagttgaggttttggttgatcttgttagtttattggagcagggtaaattgcctgatgttttggatcaagagcttcaatacagagtcgccatcacattgttccaagcatgtttaaggccattactagaccaagatgccgaaggatcatggaacaagtctatcgaagccacagcctacggcatccttatcctaactgaagctaggagagtttgtttcttcgacagattgtctgagccattgaatgaggcaatccgtagaggtatcgctttcgccgactctatgtctggaactgaagctcagttgaactacatttggatcgaaaaggttagttacgcacctgcattattgactaaatcctatttgttagcagcaagatgggctgctaagtctcctttaggcgcttccgtaggctcttctttgtggactccaccaagagaaggattggataagcatgtcagattattccatcaagctgagttattcagatcccttccagaatgggaattaagagcctccatgattgaagcagctttgttcacaccacttctaagagcacatagactagacgttttccctagacaagatgtaggtgaagacaaatatcttgatgtagttccattcttttggactgccgctaacaacagagatagaacttacgcttccactctattcctttacgatatgtgttttatcgcaatgttaaacttccagttagacgaattcatggaggccacagccggtatcttattcagagatcatatggatgatttgaggcaattgattcatgatcttttggcagagaaaacttccccaaagagttctggtagaagtagtcagggcacaaaagatgctgactcaggtatagaggaagacgtgtcaatgtccgattcagcttcagattcccaggatagaagtccagaatacgacttggttttcagtgcattgagtacctttacaaaacatgtcttgcaacacccatctatacaaagtgcctctgtatgggatagaaaactacttgctagagagatgaaggcttacttacttgctcatatccaacaagcagaagattcaactccattgtctgaattgaaagatgtgcctcaaaagactgatgtaacaagagtttctacatctactactaccttctttaactgggttagaacaacttccgcagaccatatatcctgcccatactccttccactttgtagcatgccatctaggcgcagcattgtcacctaaagggtctaacggtgattgctatccttcagctggtgagaagttcttggcagctgcagtctgcagacatttggccaccatgtgtagaatgtacaacgatcttggatcagctgaacgtgattctgatgaaggtaatttgaactccttggacttccctgaattcgccgattccgcaggaaacggagggatagaaattcagaaggccgctctattaaggttagctgagtttgagagagattcatacttagaggccttccgtcgtttacaagatgaatccaatagagttcacggtccagccggtggtgatgaagccagattgtccagaaggagaatggcaatccttgaattcttcgcccagcaggtagatttgtacggtcaagtatacgtcattagggatatttccgctcgtattcctaaaaacgaggttgagaaaaagagaaaattggatgatgctttcaattga

SEQ ID NO: 54 - protein, 983 aa, Phomopsis amygdali
MEFDEPLVDEARSLVQRTLQDYDDRYGFGTMSCAAYDTAWVSLVTKTVDGRKQWLFPECFEFLLETQSDAGGWEIGNSAPIDGILNTAASLLALKRHVQTEQIIQPQHDHKDLAGRAERAAASLRAQLAALDVSTTEHVGFEIIVPAMLDPLEAEDPSLVFDFPARKPLMKIHDAKMSRFRPEYLYGKQPMTALHSLEAFIGKIDFDKVRHHRTHGSMMGSPSSTAAYLMHASQWDGDSEAYLRHVIKHAAGQGTGAVPSAFPSTHFESSWILTTLFRAGFSASHLACDELNKLVEILEGSFEKEGGAIGYAPGFQADVDDTAKTISTLAVLGRDATPRQMIKVFEANTHFRTYPGERDPSLTANCNALSALLHQPDAAMYGSQIQKITKFVCDYWWKSDGKIKDKWNTCYLYPSVLLVEVLVDLVSLLEQGKLPDVLDQELQYRVAITLFQACLRPLLDQDAEGSWNKSIEATAYGILILTEARRVCFFDRLSEPLNEAIRRGIAFADSMSGTEAQLNYIWIEKVSYAPALLTKSYLLAARWAAKSPLGASVGSSLWTPPREGLDKHVRLFHQAELFRSLPEWELRASMIEAALFTPLLRAHRLDVFPRQDVGEDKYLDVVPFFWTAANNRDRTYASTLFLYDMCFIAMLNFQLDEFMEATAGILFRDHMDDLRQLIHDLLAEKTSPKSSGRSSQGTKDADSGIEEDVSMSDSASDSQDRSPEYDLVFSALSTFTKHVLQHPSIQSASVWDRKLLAREMKAYLLAHIQQAEDSTPLSELKDVPQKTDVTRVSTSTTTFFNWVRTTSADHISCPYSFHFVACHLGAALSPKGSNGDCYPSAGEKFLAAAVCRHLATMCRMYNDLGSAERDSDEGNLNSLDFPEFADSAGNGGIEIQKAALLRLAEFERDSYLEAFRRLQDESNRVHGPAGGDEARLSRRRMAILEFFAQQVDLYGQVYVIRDISARIPKNEVEKKRKLDDAFN

SEQ ID NO: 55 - DNA, 2646 bp, Artificial Sequence
  Codon-optimized CDPS-KS
atggcttctagtacacttatccaaaacagatcatgtggcgtcacatcatctatgtcaagttttcaaatcttcagaggtcaaccactaagatttcctggcactagaaccccagctgcagttcaatgcttgaaaaagaggagatgccttaggccaaccgaatccgtactagaatcatctcctggctctggttcatatagaatagtaactggcccttctggaattaaccctagttctaacgggcacttgcaagagggttccttgactcacaggttaccaataccaatggaaaaatctatcgataacttccaatctactctatatgtgtcagatatttggtctgaaacactacagagaactgaatgtttgctacaagtaactgaaaacgtccagatgaatgagtggattgaggaaattagaatgtactttagaaatatgactttaggtgaaatttccatgtccccttacgacactgcttgggtggctagagttccagcgttggacggttctcatgggcctcaattccacagatctttgcaatggattatcgacaaccaattaccagatggggactggggcgaaccttctcttttcttgggttacgatagagtttgtaatactttagcctgtgtgattgcgttgaaaacatggggtgttggggcacaaaacgttgaaagaggaattcagttcctacaatctaacatatacaagatggaggaagatgacgctaatcatatgccaataggattcgaaatcgtattccctgctatgatggaagatgccaaagcattaggtttggatttgccatacgatgctactattttgcaacagatttcagccgaaagagagaaaaagatgaaaaagatcccaatggcaatggtgtacaaatacccaaccactttacttcactccttagaaggcttgcatagagaagttgattggaataagttgttacaattacaatctgaaaatggtagttttctttattcacctgcttcaaccgcatgcgccttaatgtacactaaggacgttaaatgttttgattacttaaaccagttgttgatcaagttcgaccacgcatgcccaaatgtatatccagtcgatctattcgaaagattatggatggttgacagattgcagagattagggatctccagatactttgaaagagagattagagattgtttacaatacgtctacagatattggaaagattgtggaatcggatgggcttctaactcttccgtacaagatgttgatgatacagccatggcgtttagacttttaaggactcatggtttcgacgtaaaggaagattgctttagacagtttttcaaggacggagaattcttctgcttcgcaggccaatcatctcaagcagttacaggcatgtttaatctttcaagagccagtcaaacattgtttccaggagaatctttattgaaaaaggctagaaccttctctagaaacttcttgagaacaaagcatgagaacaacgaatgtttcgataaatggatcattactaaagatttggctggtgaagtcgagtataacttgaccttcccatggtatgcctctttgcctagattagaacataggacatacttagatcaatatggaatcgatgatatctggataggcaaatctttatacaaaatgcctgctgttaccaacgaagttttcctaaagttggcaaaggcagactttaacatgtgtcaagctctacacaaaaaggaattggaacaagtgataaagtggaacgcgtcctgtcaattcagagatcttgaattcgccagacaaaaatcagtagaatgctattttgctggtgcagccacaatgttcgaaccagaaatggttcaagctagattagtctgggcaagatgttgtgtattgacaactgtcttagacgattactttgaccacgggacacctgttgaggaacttagagtgtttgttcaagctgtcagaacatggaatccagagttgatcaacggtttgccagagcaagctaaaatcttgtttatgggcttatacaaaacagttaacacaattgcagaggaagcattcatggcacagaaaagagacgtccatcatcatttgaaacactattgggacaagttgataacaagtgccctaaaggaggccgaatgggcagagtcaggttacgtcccaacatttgatgaatacatggaagtagctgaaatttctgttgctctagaaccaattgtctgtagtaccttgttctttgcgggtcatagactagatgaggatgttctagatagttacgattaccatctagttatgcatttggtaaacagagtcggtagaatcttgaatgatatacaaggcatgaagagggaggcttcacaaggtaagatctcatcagttcaaatctacatggaggaacatccatctgttccatctgaggccatggcgatcgctcatcttcaagagttagttgataattcaatgcagcaattgacatacgaagttcttaggttcactgcggttccaaaaagttgtaagagaatccacttgaatatggctaaaatcatgcatgccttctacaaggatactgatggattctcatcccttactgcaatgacaggattcgtcaaaaaggttcttttcgaacctgtgcctgagtaa

SEQ ID NO: 56 - protein, 881 aa, Physcomitrella patens
MASSTLIQNRSCGVTSSMSSFQIFRGQPLRFPGTRTPAAVQCLKKRRCLRPTESVLESSPGSGSYRIVTGPSGINPSSNGHLQEGSLTHRLPIPMEKSIDNFQSTLYVSDIWSETLQRTECLLQVTENVQMNEWIEEIRMYFRNMTLGEISMSPYDTAWVARVPALDGSHGPQFHRSLQWIIDNQLPDGDWGEPSLFLGYDRVCNTLACVIALKTWGVGAQNVERGIQFLQSNIYKMEEDDANHMPIGFEIVFPAMMEDAKALGLDLPYDATILQQISAEREKKMKKIPMAMVYKYPTTLLHSLEGLHREVDWNKLLQLQSENGSFLYSPASTACALMYTKDVKCFDYLNQLLIKFDHACPNVYPVDLFERLWMVDRLQRLGISRYFEREIRDCLQYVYRYWKDCGIGWASNSSVQDVDDTAMAFRLLRTHGFDVKEDCFRQFFKDGEFFCFAGQSSQAVTGMFNLSRASQTLFPGESLLKKARTFSRNFLRTKHENNECFDKWIITKDLAGEVEYNLTFPWYASLPRLEHRTYLDQYGIDDIWIGKSLYKMPAVTNEVFLKLAKADFNMCQALHKKELEQVIKWNASCQFRDLEFARQKSVECYFAGAATMFEPEMVQARLVWARCCVLTTVLDDYFDHGTPVEELRVFVQAVRTWNPELINGLPEQAKILFMGLYKTVNTIAEEAFMAQKRDVHHHLKHYWDKLITSALKEAEWAESGYVPTFDEYMEVAEISVALEPIVCSTLFFAGHRLDEDVLDSYDYHLVMHLVNRVGRILNDIQGMKREASQGKISSVQIYMEEHPSVPSEAMAIAHLQELVDNSMQQLTYEVLRFTAVPKSCKRIHLNMAKIMHAFYKDTDGFSSLTAMTGFVKKVLFEPVPE

SEQ ID NO: 57 - DNA, 2859 bp, Artificial Sequence
  Codon-optimized CDPS-KS
atgcctggtaaaattgaaaatggtaccccaaaggacctcaagactggaaatgattttgtttctgctgctaagagtttactagatcgagctttcaaaagtcatcattcctactacggattatgctcaacttcatgtcaagtttatgatacagcttgggttgcaatgattccaaaaacaagagataatgtaaaacagtggttgtttccagaatgtttccattacctcttaaaaacacaagccgcagatggctcatggggttcattgcctacaacacagacagcgggtatcctagatacagcctcagctgtgctggcattattgtgccacgcacaagagcctttacaaatattggatgtatctccagatgaaatggggttgagaatagaacacggtgtcacatccttgaaacgtcaattagcagtttggaatgatgtggaggacaccaaccatattggcgtcgagtttatcataccagccttactttccatgctagaaaaggaattagatgttccatcttttgaatttccatgtaggtccatcttagagagaatgcacggggagaaattaggtcatttcgacctggaacaagtttacggcaagccaagctcattgttgcactcattggaagcatttctcggtaagctagattttgatcgactatcacatcacctataccacggcagtatgatggcatctccatcttcaacggctgcttatcttattggggctacaaaatgggatgacgaagccgaagattacctaagacatgtaatgcgtaatggtgcaggacatgggaatggaggtatttctggtacatttccaactactcatttcgaatgtagctggattatagcaacgttgttaaaggttggctttactttgaagcaaattgacggcgatggcttaagaggtttatcaaccatcttacttgaggcgcttcgtgatgagaatggtgtcataggctttgcccctagaacagcagatgtagatgacacagccaaagctctattggccttgtcattggtaaaccagccagtgtcacctgatatcatgattaaggtctttgagggcaaagaccattttaccacttttggttcagaaagagatccatcattgacttccaacctgcacgtccttttatctttacttaaacaatctaacttgtctcaataccatcctcaaatcctcaaaacaacattattcacttgtagatggtggtggggttccgatcattgtgtcaaagacaaatggaatttgagtcacctatatccaactatgttgttggttgaagccttcactgaagtgctccatctcattgacggtggtgaattgtctagtctgtttgatgaatcctttaagtgtaagattggtcttagcatctttcaagcggtacttagaataatcctcacccaagacaacgacggctcttggagaggatacagagaacagacgtgttacgcaatattggctttagttcaagcgagacatgtatgctttttcactcacatggttgacagactgcaatcatgtgttgatcgaggtttctcatggttgaaatcttgctcttttcattctcaagacctgacttggacctctaaaacagcttatgaagtgggtttcgtagctgaagcatataaactagctgctttacaatctgcttccctggaggttcctgctgccaccattggacattctgtcacgtctgccgttccatcaagtgatcttgaaaaatacatgagattggtgagaaaaactgcgttattctctccactggatgagtggggtctaatggcttctatcatcgaatcttcatttttcgtaccattactgcaggcacaaagagttgaaatataccctagagataatatcaaggtggacgaagataagtacttgtctattatcccattcacatgggtcggatgcaataataggtctagaactttcgcaagtaacagatggctatacgatatgatgtacctttcattactcggctatcaaaccgacgagtacatggaagctgtagctgggccagtgtttggggatgtttccttgttacatcaaacaattgataaggtgattgataatacaatgggtaaccttgcgagagccaatggaacagtacacagtggtaatggacatcagcacgaatctcctaatataggtcaagtcgaggacaccttgactcgtttcacaaattcagtcttgaatcacaaagacgtccttaactctagctcatctgatcaagatactttgagaagagagtttagaacattcatgcacgctcatataacacaaatcgaagataactcacgattcagtaagcaagcctcatccgatgcgttttcctctcctgaacaatcttactttcaatgggtgaactcaactggtggctcacatgtcgcttgcgcctattcatttgccttctctaattgcctcatgtctgcaaatttgttgcagggtaaagacgcatttccaagcggaacgcaaaagtacttaatctcctctgttatgagacatgccacaaacatgtgtagaatgtataacgactttggctctattgccagagacaacgctgagagaaatgttaatagtattcattttcctgagtttactctctgtaacggaacttctcaaaacctagatgaaaggaaggaaagacttctgaaaatcgcaacttacgaacaagggtatttggatagagcactagaggccttggaaagacagagtagagatgatgccggagacagagctggatctaaagatatgagaaagttgaaaatcgttaagttattctgtgatgttacggacttatacgatcagctctacgttatcaaagatttgtcatcctctatgaagtaa

SEQ ID NO: 58 - protein, 952 aa, Gibberella fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 59 - DNA, 1542 bp, Artificial Sequence
  Codon-optimized KO
atggatgctgtgacgggtttgttaactgtcccagcaaccgctataactattggtggaactgctgtagcattggcggtagcgctaatcttttggtacctgaaatcctacacatcagctagaagatcccaatcaaatcatcttccaagagtgcctgaagtcccaggtgttccattgttaggaaatctgttacaattgaaggagaaaaagccatacatgacttttacgagatgggcagcgacatatggacctatctatagtatcaaaactggggctacaagtatggttgtggtatcatctaatgagatagccaaggaggcattggtgaccagattccaatccatatctacaaggaacttatctaaagccctgaaagtacttacagcagataagacaatggtcgcaatgtcagattatgatgattatcataaaacagttaagagacacatactgaccgccgtcttgggtcctaatgcacagaaaaagcatagaattcacagagatatcatgatggataacatatctactcaacttcatgaattcgtgaaaaacaacccagaacaggaagaggtagaccttagaaaaatctttcaatctgagttattcggcttagctatgagacaagccttaggaaaggatgttgaaagtttgtacgttgaagacctgaaaatcactatgaatagagacgaaatctttcaagtccttgttgttgatccaatgatgggagcaatcgatgttgattggagagacttctttccatacctaaagtgggtcccaaacaaaaagttcgaaaatactattcaacaaatgtacatcagaagagaagctgttatgaaatctttaatcaaagagcacaaaaagagaatagcgtcaggcgaaaagctaaatagttatatcgattaccttttatctgaagctcaaactttaaccgatcagcaactattgatgtccttgtgggaaccaatcattgaatcttcagatacaacaatggtcacaacagaatgggcaatgtacgaattagctaaaaaccctaaattgcaagataggttgtacagagacattaagtccgtctgtggatctgaaaagataaccgaagagcatctatcacagctgccttacattacagctattttccacgaaacactgagaagacactcaccagttcctatcattcctctaagacatgtacatgaagataccgttctaggcggctaccatgttcctgctggcacagaacttgccgttaacatctacggttgcaacatggacaaaaacgtttgggaaaatccagaggaatggaacccagaaagattcatgaaagagaatgagacaattgattttcaaaagacgatggccttcggtggtggtaagagagtttgtgctggttccttgcaagcccttttaactgcatctattgggattgggagaatggttcaagagttcgaatggaaactgaaggatatgactcaagaggaagtgaacacgataggcctaactacacaaatgttaagaccattgagagctattatcaaacctaggatctaa

SEQ ID NO: 60 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKEHKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 61 - DNA, 1566 bp, Artificial Sequence
  Codon-optimized KO
aagcttactagtaaaatggacggtgtcatcgatatgcaaaccattccattgagaaccgctattgctattggtggtactgctgttgctttggttgttgcattatacttttggttcttgagatcctacgcttccccatctcatcattctaatcatttgccaccagtacctgaagttccaggtgttccagttttgggtaatttgttgcaattgaaagaaaaaaagccttacatgaccttcaccaagtgggctgaaatgtatggtccaatctactctattagaactggtgctacttccatggttgttgtctcttctaacgaaatcgccaaagaagttgttgttaccagattcccatctatctctaccagaaaattgtcttacgccttgaaggttttgaccgaagataagtctatggttgccatgtctgattatcacgattaccataagaccgtcaagagacatattttgactgctgttttgggtccaaacgcccaaaaaaagtttagagcacatagagacaccatgatggaaaacgtttccaatgaattgcatgccttcttcgaaaagaacccaaatcaagaagtcaacttgagaaagatcttccaatcccaattattcggtttggctatgaagcaagccttgggtaaagatgttgaatccatctacgttaaggatttggaaaccaccatgaagagagaagaaatcttcgaagttttggttgtcgatccaatgatgggtgctattgaagttgattggagagactttttcccatacttgaaatgggttccaaacaagtccttcgaaaacatcatccatagaatgtacactagaagagaagctgttatgaaggccttgatccaagaacacaagaaaagaattgcctccggtgaaaacttgaactcctacattgattacttgttgtctgaagcccaaaccttgaccgataagcaattattgatgtctttgtgggaacctattatcgaatcttctgataccactatggttactactgaatgggctatgtacgaattggctaagaatccaaacatgcaagacagattatacgaagaaatccaatccgtttgcggttccgaaaagattactgaagaaaacttgtcccaattgccatacttgtacgctgttttccaagaaactttgagaaagcactgtccagttcctattatgccattgagatatgttcacgaaaacaccgttttgggtggttatcatgttccagctggtactgaagttgctattaacatctacggttgcaacatggataagaaggtctgggaaaatccagaagaatggaatccagaaagattcttgtccgaaaaagaatccatggacttgtacaaaactatggcttttggtggtggtaaaagagtttgcgctggttctttacaagccatggttatttcttgcattggtatcggtagattggtccaagattttgaatggaagttgaaggatgatgccgaagaagatgttaacactttgggtttgactacccaaaagttgcatccattattggccttgattaacccaagaaagtaactcgagccgcgg

SEQ ID NO: 62 - protein, 512 aa, Lactuca sativa
MDGVIDMQTIPLRTAIAIGGTAVALVVALYFWFLRSYASPSHHSNHLPPVPEVPGVPVLGNLLQLKEKKPYMTFTKWAEMYGPIYSIRTGATSMVVVSSNEIAKEVVVTRFPSISTRKLSYALKVLTEDKSMVAMSDYHDYHKTVKRHILTAVLGPNAQKKFRAHRDTMMENVSNELHAFFEKNPNQEVNLRKIFQSQLFGLAMKQALGKDVESIYVKDLETTMKREEIFEVLVVDPMMGAIEVDWRDFFPYLKWVPNKSFENIIHRMYTRREAVMKALIQEHKKRIASGENLNSYIDYLLSEAQTLTDKQLLMSLWEPIIESSDTTMVTTEWAMYELAKNPNMQDRLYEEIQSVCGSEKITEENLSQLPYLYAVFQETLRKHCPVPIMPLRYVHENTVLGGYHVPAGTEVAINIYGCNMDKKVWENPEEWNPERFLSEKESMDLYKTMAFGGGKRVCAGSLQAMVISCIGIGRLVQDFEWKLKDDAEEDVNTLGLTTQKLHPLLALINPRK

SEQ ID NO: 63 - DNA, 1535 bp, Rubus suavissimus
atggccaccctccttgagcatttccaagctatgccctttgccatccctattgcactggctgctctgtcttggctgttcctcttttacatcaaagtttcattcttttccaacaagagtgctcaggctaagctccctcctgtgccagtggttcctgggctgccggtgattgggaatttactgcaactcaaggagaagaaaccctaccagacttttacaaggtgggctgaggagtatggaccaatctattctatcaggactggtgcttccaccatggtcgttctcaataccacccaagttgcaaaagaggccatggtgaccagatatttatccatctcaaccagaaagctatcaaacgcactaaagattcttactgctgataaatgtatggttgcaataagtgactacaacgattttcacaagatgataaagcgatacatactctcaaatgttcttggacctagtgctcagaagcgtcaccggagcaacagagataccttgagagctaatgtctgcagccgattgcattctcaagtaaagaactctcctcgagaagctgtgaatttcagaagagtttttgagtgggaactctttggaattgcattgaagcaagcctttggaaaggacatagaaaagcccatttatgtggaggaacttggcactacactgtcaagagatgagatctttaaggttctagtgcttgacataatggagggtgcaattgaggttgattggagagatttcttcccttacctgagatggattccgaatacgcgcatggaaacaaaaattcagcgactctatttccgcaggaaagcagtgatgactgccctgatcaacgagcagaagaagcgaattgcttcaggagaggaaatcaactgttatatcgacttcttgcttaaggaagggaagacactgacaatggaccaaataagtatgttgctttgggagacggttattgaaacagcagatactacaatggtaacgacagaatgggctatgtatgaagttgctaaagactcaaagcgtcaggatcgtctctatcaggaaatccaaaaggtttgtggatcggagatggttacagaggaatacttgtcccaactgccgtacctgaatgcagttttccatgaaacgctaaggaagcacagtccggctgcgttagttcctttaagatatgcacatgaagatacccaactaggaggttactacattccagctggaactgagattgctataaacatatacgggtgtaacatggacaagcatcaatgggaaagccctgaggaatggaaaccggagagatttttggacccgaaatttgatcctatggatttgtacaagaccatggcttttggggctggaaagagggtatgtgctggttctcttcaggcaatgttaatagcgtgcccgacgattggtaggctggtgcaggagtttgagtggaagctgagagatggagaagaagaaaatgtagatactgttgggctcaccactcacaaacgctatccaatgcatgcaatcctgaagccaagaagtta

SEQ ID NO: 64 - DNA, 1536 bp, Artificial Sequence
  Codon-optimized KO
atggctaccttgttggaacattttcaagctatgccattcgctattccaattgctttggctgctttgtcttggttgtttttgttctacatcaaggtttctttcttctccaacaaatccgctcaagctaaattgccaccagttccagttgttccaggtttgccagttattggtaatttgttgcaattgaaagaaaagaagccataccaaaccttcactagatgggctgaagaatatggtccaatctactctattagaactggtgcttctactatggttgtcttgaacactactcaagttgccaaagaagctatggttaccagatacttgtctatctctaccagaaagttgtccaacgccttgaaaattttgaccgctgataagtgcatggttgccatttctgattacaacgatttccacaagatgatcaagagatatatcttgtctaacgttttgggtccatctgcccaaaaaagacatagatctaacagagataccttgagagccaacgtttgttctagattgcattcccaagttaagaactctccaagagaagctgtcaactttagaagagttttcgaatgggaattattcggtatcgctttgaaacaagccttcggtaaggatattgaaaagccaatctacgtcgaagaattgggtactactttgtccagagatgaaatcttcaaggttttggtcttggacattatggaaggtgccattgaagttgattggagagattttttcccatacttgcgttggattccaaacaccagaatggaaactaagatccaaagattatactttagaagaaaggccgttatgaccgccttgattaacgaacaaaagaaaagaattgcctccggtgaagaaatcaactgctacatcgatttcttgttgaaagaaggtaagaccttgaccatggaccaaatctctatgttgttgtgggaaaccgttattgaaactgctgataccacaatggttactactgaatgggctatgtacgaagttgctaaggattctaaaagacaagacagattataccaagaaatccaaaaggtctgcggttctgaaatggttacagaagaatacttgtcccaattgccatacttgaatgctgttttccacgaaactttgagaaaacattctccagctgctttggttccattgagatatgctcatgaagatactcaattgggtggttattacattccagccggtactgaaattgccattaacatctacggttgcaacatggacaaacaccaatgggaatctccagaagaatggaagccagaaagatttttggatcctaagtttgacccaatggacttgtacaaaactatggcttttggtgctggtaaaagagtttgcgctggttctttacaagctatgttgattgcttgtccaaccatcggtagattggttcaagaatttgaatggaagttgagagatggtgaagaagaaaacgttgatactgttggtttgaccacccataagagatatccaatgcatgctattttgaagccaagatcttaa

SEQ ID NO: 65 - DNA, 1572 bp, Artificial Sequence
  Codon-optimized KO
aagcttactagtaaaatggcctccatcacccatttcttacaagattttcaagctactccattcgctactgcttttgctgttggtggtgtttctttgttgatattcttcttcttcatccgtggtttccactctactaagaaaaacgaatattacaagttgccaccagttccagttgttccaggtttgccagttgttggtaatttgttgcaattgaaagaaaagaagccatacaagactttcttgagatgggctgaaattcatggtccaatctactctattagaactggtgcttctaccatggttgttgttaactctactcatgttgccaaagaagctatggttaccagattctcttcaatctctaccagaaagttgtccaaggctttggaattattgacctccaacaaatctatggttgccacctctgattacaacgaatttcacaagatggtcaagaagtacatcttggccgaattattgggtgctaatgctcaaaagagacacagaattcatagagacaccttgatcgaaaacgtcttgaacaaattgcatgcccataccaagaattctccattgcaagctgttaacttcagaaagatcttcgaatctgaattattcggtttggctatgaagcaagccttgggttatgatgttgattccttgttcgttgaagaattgggtactaccttgtccagagaagaaatctacaacgttttggtcagtgacatgttgaagggtgctattgaagttgattggagagactttttcccatacttgaaatggatcccaaacaagtccttcgaaatgaagattcaaagattggcctctagaagacaagccgttatgaactctattgtcaaagaacaaaagaagtccattgcctctggtaagggtgaaaactgttacttgaattacttgttgtccgaagctaagactttgaccgaaaagcaaatttccattttggcctgggaaaccattattgaaactgctgatacaactgttgttaccactgaatgggctatgtacgaattggctaaaaacccaaagcaacaagacagattatacaacgaaatccaaaacgtctgcggtactgataagattaccgaagaacatttgtccaagttgccttacttgtctgctgtttttcacgaaaccttgagaaagtattctccatctccattggttccattgagatacgctcatgaagatactcaattgggtggttattatgttccagccggtactgaaattgctgttaatatctacggttgcaacatggacaagaatcaatgggaaactccagaagaatggaagccagaaagatttttggacgaaaagtacgatccaatggacatgtacaagactatgtcttttggttccggtaaaagagtttgcgctggttctttacaagctagtttgattgcttgtacctccatcggtagattggttcaagaatttgaatggagattgaaagacggtgaagttgaaaacgttgataccttgggtttgactacccataagttgtatccaatgcaagctatcttgcaacctagaaactgactcgagccgcgg

SEQ ID NO: 66 - protein, 514 aa, Castanea mollissima
MASITHFLQDFQATPFATAFAVGGVSLLIFFFFIRGFHSTKKNEYYKLPPVPVVPGLPVVGNLLQLKEKKPYKTFLRWAEIHGPIYSIRTGASTMVVVNSTHVAKEAMVTRFSSISTRKLSKALELLTSNKSMVATSDYNEFHKMVKKYILAELLGANAQKRHRIHRDTLIENVLNKLHAHTKNSPLQAVNFRKIFESELFGLAMKQALGYDVDSLFVEELGTTLSREEIYNVLVSDMLKGAIEVDWRDFFPYLKWIPNKSFEMKIQRLASRRQAVMNSIVKEQKKSIASGKGENCYLNYLLSEAKTLTEKQISILAWETIIETADTTVVTTEWAMYELAKNPKQQDRLYNEIQNVCGTDKITEEHLSKLPYLSAVFHETLRKYSPSPLVPLRYAHEDTQLGGYYVPAGTEIAVNIYGCNMDKNQWETPEEWKPERFLDEKYDPMDMYKTMSFGSGKRVCAGSLQASLIACTSIGRLVQEFEWRLKDGEVENVDTLGLTTHKLYPMQAILQPRN

SEQ ID NO: 67 - DNA, 1512 bp, Artificial Sequence
  Codon-optimized KO
atgatttccttgttgttgggttttgttgtctcctccttcttgtttatcttcttcttgaaaaaattgttgttcttcttcagtcgtcacaaaatgtccgaagtttctagattgccatctgttccagttccaggttttccattgattggtaacttgttgcaattgaaagaaaagaagccacacaagactttcaccaagtggtctgaattatatggtccaatctactctatcaagatgggttcctcttctttgatcgtcttgaactctattgaaaccgccaaagaagctatggtcagtagattctcttcaatctctaccagaaagttgtctaacgctttgactgttttgacctgcaacaaatctatggttgctacctctgattacgatgactttcataagttcgtcaagagatgcttgttgaacggtttgttgggtgctaatgctcaagaaagaaaaagacattacagagatgccttgatcgaaaacgttacctctaaattgcatgcccataccagaaatcatccacaagaaccagttaacttcagagccattttcgaacacgaattattcggtgttgctttgaaacaagccttcggtaaagatgtcgaatccatctatgtaaaagaattgggtgtcaccttgtccagagatgaaattttcaaggttttggtccacgacatgatggaaggtgctattgatgttgattggagagatttcttcccatacttgaaatggatcccaaacaactctttcgaagccagaattcaacaaaagcacaagagaagattggctgttatgaacgccttgatccaagacagattgaatcaaaacgattccgaatccgatgatgactgctacttgaatttcttgatgtctgaagctaagaccttgaccatggaacaaattgctattttggtttgggaaaccattatcgaaactgctgataccactttggttactactgaatgggctatgtacgaattggccaaacatcaatctgttcaagatagattattcaaagaaatccaatccgtctgcggtggtgaaaagatcaaagaagaacaattgccaagattgccttacgtcaatggtgtttttcacgaaaccttgagaaagtattctccagctccattggttccaattagatacgctcatgaagatacccaaattggtggttatcatattccagccggttctgaaattgccattaacatctacggttgcaacatggataagaagagatgggaaagacctgaagaatggtggccagaaagatttttggaagatagatacgaatcctccgacttgcataagactatggcttttggtgctggtaaaagagtttgtgctggtgctttacaagctagtttgatggctggtattgctatcggtagattggttcaagaattcgaatggaagttgagagatggtgaagaagaaaacgttgatacttacggtttgacctcccaaaagttgtatccattgatggccattatcaacccaagaagatcttaa

SEQ ID NO: 68 - protein, 506 aa, Thellungiella halophila
MASMISLLLGFVVSSFLFIFFLKKLLFFFSRHKMSEVSRLPSVPVPGFPLIGNLLQLKEKKPHKTFTKWSELYGPIYSIKMGSSSLIVLNSIETAKEAMVSRFSSISTRKLSNALTVLTCNKSMVATSDYDDFHKFVKRCLLNGLLGANAQERKRHYRDALIENVTSKLHAHTRNHPQEPVNFRAIFEHELFGVALKQAFGKDVESIYVKELGVTLSRDEIFKVLVHDMMEGAIDVDWRDFFPYLKWIPNNSFEARIQQKHKRRLAVMNALIQDRLNQNDSESDDDCYLNFLMSEAKTLTMEQIAILVWETIIETADTTLVTTEWAMYELAKHQSVQDRLFKEIQSVCGGEKIKEEQLPRLPYVNGVFHETLRKYSPAPLVPIRYAHEDTQIGGYHIPAGSEIAINIYGCNMDKKRWERPEEWWPERFLEDRYESSDLHKTMAFGAGKRVCAGALQASLMAGIAIGRLVQEFEWKLRDGEEENVDTYGLTSQKLYPLMAIINPRRS

SEQ ID NO: 69 - DNA, 1554 bp, Artificial Sequence
  Codon-optimized KO
aagcttactagtaaaatggacatgatgggtattgaagctgttccatttgctactgctgttgttttgggtggtatttccttggttgttttgatcttcatcagaagattcgtttccaacagaaagagatccgttgaaggtttgccaccagttccagatattccaggtttaccattgattggtaacttgttgcaattgaaagaaaagaagccacataagacctttgctagatgggctgaaacttacggtccaattttctctattagaactggtgcttctaccatgatcgtcttgaattcttctgaagttgccaaagaagctatggtcactagattctcttcaatctctaccagaaagttgtccaacgccttgaagattttgaccttcgataagtgtatggttgccacctctgattacaacgattttcacaaaatggtcaagggtttcatcttgagaaacgttttaggtgctccagcccaaaaaagacatagatgtcatagagataccttgatcgaaaacatctctaagtacttgcatgcccatgttaagacttctccattggaaccagttgtcttgaagaagattttcgaatccgaaattttcggtttggctttgaaacaagccttgggtaaggatatcgaatccatctatgttgaagaattgggtactaccttgtccagagaagaaatttttgccgttttggttgttgatccaatggctggtgctattgaagttgattggagagattttttcccatacttgtcctggattccaaacaagtctatggaaatgaagatccaaagaatggattttagaagaggtgctttgatgaaggccttgattggtgaacaaaagaaaagaatcggttccggtgaagaaaagaactcctacattgatttcttgttgtctgaagctaccactttgaccgaaaagcaaattgctatgttgatctgggaaaccatcatcgaaatttccgatacaactttggttacctctgaatgggctatgtacgaattggctaaagacccaaatagacaagaaatcttgtacagagaaatccacaaggtttgcggttctaacaagttgactgaagaaaacttgtccaagttgccatacttgaactctgttttccacgaaaccttgagaaagtattctccagctccaatggttccagttagatatgctcatgaagatactcaattgggtggttaccatattccagctggttctcaaattgccattaacatctacggttgcaacatgaacaaaaagcaatgggaaaatcctgaagaatggaagccagaaagattcttggacgaaaagtatgacttgatggacttgcataagactatggcttttggtggtggtaaaagagtttgtgctggtgctttacaagcaatgttgattgcttgcacttccatcggtagattcgttcaagaatttgaatggaagttgatgggtggtgaagaagaaaacgttgatactgttgctttgacctcccaaaaattgcatccaatgcaagccattattaaggccagagaatgactcgagccgcgg

SEQ ID NO: 70 - protein, 508 aa, Vitis vinifera
MDMMGIEAVPFATAVVLGGISLVVLIFIRRFVSNRKRSVEGLPPVPDIPGLPLIGNLLQLKEKKPHKTFARWAETYGPIFSIRTGASTMIVLNSSEVAKEAMVTRFSSISTRKLSNALKILTFDKCMVATSDYNDFHKMVKGFILRNVLGAPAQKRHRCHRDTLIENISKYLHAHVKTSPLEPVVLKKIFESEIFGLALKQALGKDIESIYVEELGTTLSREEIFAVLVVDPMAGAIEVDWRDFFPYLSWIPNKSMEMKIQRMDFRRGALMKALIGEQKKRIGSGEEKNSYIDFLLSEATTLTEKQIAMLIWETIIEISDTTLVTSEWAMYELAKDPNRQEILYREIHKVCGSNKLTEENLSKLPYLNSVFHETLRKYSPAPMVPVRYAHEDTQLGGYHIPAGSQIAINIYGCNMNKKQWENPEEWKPERFLDEKYDLMDLHKTMAFGGGKRVCAGALQAMLIACTSIGRFVQEFEWKLMGGEEENVDTVALTSQKLHPMQAIIKARE

SEQ ID NO: 71 - DNA, 1593 bp, Artificial Sequence
  Codon-optimized KO
aagcttaaaatgagtaagtctaatagtatgaattctacatcacacgaaaccctttttcaacaattggtcttgggtttggaccgtatgccattgatggatgttcactggttgatctacgttgctttcggcgcatggttatgttcttatgtgatacatgttttatcatcttcctctacagtaaaagtgccagttgttggatacaggtctgtattcgaacctacatggttgcttagacttagattcgtctgggaaggtggctctatcataggtcaagggtacaataagtttaaagactctattttccaagttaggaaattgggaactgatattgtcattataccacctaactatattgatgaagtgagaaaattgtcacaggacaagactagatcagttgaacctttcattaatgattttgcaggtcaatacacaagaggcatggttttcttgcaatctgacttacaaaaccgtgttatacaacaaagactaactccaaaattggtttccttgaccaaggtcatgaaggaagagttggattatgctttaacaaaagagatgcctgatatgaaaaatgacgaatgggtagaagtagatatcagtagtataatggtgagattgatttccaggatctccgccagagtctttctagggcctgaacactgtcgtaaccaggaatggttgactactacagcagaatattcagaatcacttttcattacagggtttatcttaagagttgtacctcatatcttaagaccattcatcgcccctctattaccttcatacaggactctacttagaaacgtttcaagtggtagaagagtcatcggtgacatcataagatctcagcaaggggatggtaacgaagatatactttcctggatgagagatgctgccacaggagaggaaaagcaaatcgataacattgctcagagaatgttaattctttctttagcatcaatccacactactgcgatgaccatgacacatgccatgtacgatctatgtgcttgccctgagtacattgaaccattaagagatgaagttaaatctgttgttggggcttctggctgggacaagacagcgttaaacagatttcataagttggactccttcctaaaagagtcacaaagattcaacccagtattcttattgacattcaatagaatctaccatcaatctatgaccttatcagatggcactaacattccatctggaacacgtattgctgttccatcacacgcaatgttgcaagattctgcacatgtcccaggtccaaccccacctactgaatttgatggattcagatatagtaagatacgttctgatagtaactacgcacaaaagtacctattctccatgaccgattcttcaaacatggctttcggatacggcaagtatgcttgtccaggtagattttacgcgtctaatgagatgaaactaacattagccattttgttgctacaatttgagttcaaactaccagatggtaaaggtcgtcctagaaatatcactatcgattctgatatgattccagacccaagagctagactttgcgtcagaaaaagatcacttagagatgaatgaccgcgg

SEQ ID NO: 72 - protein, 525 aa, Gibberella fujikuroi
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 73 - DNA, 1515 bp, Artificial Sequence
  Codon-optimized KO
aagcttaaaatggaagatcctactgtcttatatgcttgtcttgccattgcagttgcaactttcgttgttagatggtacagagatccattgagatccatcccaacagttggtggttccgatttgcctattctatcttacatcggcgcactaagatggacaagacgtggcagagagatacttcaagagggatatgatggctacagaggatctacattcaaaatcgcgatgttagaccgttggatcgtgatcgcaaatggtcctaaactagctgatgaagtcagacgtagaccagatgaagagttaaactttatggacggattaggagcattcgtccaaactaagtacaccttaggtgaagctattcataacgatccataccatgtcgatatcataagagaaaaactaacaagaggccttccagccgtgcttcctgatgtcattgaagagttgacacttgcggttagacagtacattccaacagaaggtgatgaatgggtgtccgtaaactgttcaaaggccgcaagagatattgttgctagagcttctaatagagtctttgtaggtttgcctgcttgcagaaaccaaggttacttagatttggcaatagactttacattgtctgttgtcaaggatagagccatcatcaatatgtttccagaattgttgaagccaatagttggcagagttgtaggtaacgccaccagaaatgttcgtagagctgttccttttgttgctccattggtggaggaaagacgtagacttatggaagagtacggtgaagactggtctgaaaaacctaatgatatgttacagtggataatggatgaagctgcatccagagatagttcagtgaaggcaatcgcagagagattgttaatggtgaacttcgcggctattcatacctcatcaaacactatcactcatgctttgtaccaccttgccgaaatgcctgaaactttgcaaccacttagagaagagatcgaaccattagtcaaagaggagggctggaccaaggctgctatgggaaaaatgtggtggttagattcatttctaagagaatctcaaagatacaatggcattaacatcgtatctttaactagaatggctgacaaagatattacattgagtgatggcacatttttgccaaaaggtactctagtggccgttccagcgtattctactcatagagatgatgctgtctacgctgatgccttagtattcgatcctttcagattctcacgtatgagagcgagagaaggtgaaggtacaaagcaccagttcgttaatacttcagtcgagtacgttccatttggtcacggaaagcatgcttgtccaggaagattcttcgccgcaaacgaattgaaagcaatgttggcttacattgttctaaactatgatgtaaagttgcctggtgacggtaaacgtccattgaacatgtattggggtccaacagttttgcctgcaccagcaggccaagtattgttcagaaagagacaagttagtctataaccgcgg

SEQ ID NO: 74 - protein, 499 aa, Trametes versicolor
MEDPTVLYACLAIAVATFVVRWYRDPLRSIPTVGGSDLPILSYIGALRWTRRGREILQEGYDGYRGSTFKIAMLDRWIVIANGPKLADEVRRRPDEELNFMDGLGAFVQTKYTLGEAIHNDPYHVDIIREKLTRGLPAVLPDVIEELTLAVRQYIPTEGDEWVSVNCSKAARDIVARASNRVFVGLPACRNQGYLDLAIDFTLSVVKDRAIINMFPELLKPIVGRVVGNATRNVRRAVPFVAPLVEERRRLMEEYGEDWSEKPNDMLQWIMDEAASRDSSVKAIAERLLMVNFAAIHTSSNTITHALYHLAEMPETLQPLREEIEPLVKEEGWTKAAMGKMWWLDSFLRESQRYNGINIVSLTRMADKDITLSDGTFLPKGTLVAVPAYSTHRDDAVYADALVFDPFRFSRMRAREGEGTKHQFVNTSVEYVPFGHGKHACPGRFFAANELKAMLAYIVLNYDVKLPGDGKRPLNMYWGPTVLPAPAGQVLFRKRQVSL

SEQ ID NO: 75 - DNA, 1530 bp, Artificial Sequence
  Codon-optimized KO
atggcatttttctctatgatttcaattttgttgggatttgttatttcttctttcatcttcatctttttcttcaaaaagttacttagttttagtaggaaaaacatgtcagaagtttctactttgccaagtgttccagtagtgcctggttttccagttattgggaatttgttgcaactaaaggagaaaaagcctcataaaactttcactagatggtcagagatatatggacctatctactctataaagatgggttcttcatctcttattgtattgaacagtacagaaactgctaaggaagcaatggtcactagattttcatcaatatctaccagaaaattgtcaaacgccctaacagttctaacctgcgataagtctatggtcgccacttctgattatgatgacttccacaaattagttaagagatgtttgctaaatggacttcttggtgctaatgctcaaaagagaaaaagacactacagagatgctttgattgaaaatgtgagttccaagctacatgcacacgctagagatcatccacaagagccagttaactttagagcaattttcgaacacgaattgtttggtgtagcattaaagcaagccttcggtaaagacgtagaatccatatacgtcaaggagttaggcgtaacattatcaaaagatgaaatctttaaggtgcttgtacatgatatgatggagggtgcaattgatgtagattggagagatttcttcccatatttgaaatggatccctaataagtcttttgaagctaggatacaacaaaagcacaagagaagactagctgttatgaacgcacttatacaggacagattgaagcaaaatgggtctgaatcagatgatgattgttaccttaacttcttaatgtctgaggctaaaacattgactaaggaacagatcgcaatccttgtctgggaaacaatcattgaaacagcagatactaccttagtcacaactgaatgggccatatacgagctagccaaacatccatctgtgcaagataggttgtgtaaggagatccagaacgtgtgtggtggagagaaattcaaggaagagcagttgtcacaagttccttaccttaacggcgttttccatgaaaccttgagaaaatactcacctgcaccattagttcctattagatacgcccacgaagatacacaaatcggtggctaccatgttccagctgggtccgaaattgctataaacatctacgggtgcaacatggacaaaaagagatgggaaagaccagaagattggtggccagaaagattcttagatgatggcaaatatgaaacatctgatttgcataaaacaatggctttcggagctggcaaaagagtgtgtgccggtgctctacaagcctccctaatggctggtatcgctattggtagattggtccaagagttcgaatggaaacttagagatggtgaagaggaaaatgtcgatacttatgggttaacatctcaaaagttatacccactaatggcaatcatcaatcctagaagatcctaa

SEQ ID NO: 76 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETAKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 77 - DNA, 2133 bp, Artificial Sequence
  Codon-optimized CPR
atgcaatcagattcagtcaaagtctctccatttgatttggtttccgctgctatgaatggcaaggcaatggaaaagttgaacgctagtgaatctgaagatccaacaacattgcctgcactaaagatgctagttgaaaatagagaattgttgacactgttcacaacttccttcgcagttcttattgggtgtcttgtatttctaatgtggagacgttcatcctctaaaaagctggtacaagatccagttccacaagttatcgttgtaaagaagaaagagaaggagtcagaggttgatgacgggaaaaagaaagtttctattttctacggcacacaaacaggaactgccgaaggttttgctaaagcattagtcgaggaagcaaaagtgagatatgaaaagacctctttcaaggttatcgatctagatgactacgctgcagatgatgatgaatatgaggaaaaactgaaaaaggaatccttagccttcttcttcttggccacatacggtgatggtgaacctactgataatgctgctaacttctacaagtggttcacagaaggcgacgataaaggtgaatggctgaaaaagttacaatacggagtatttggtttaggtaacagacaatatgaacatttcaacaagatcgctattgtagttgatgataaacttactgaaatgggagccaaaagattagtaccagtaggattaggggatgatgatcagtgtatagaagatgacttcaccgcctggaaggaattggtatggccagaattggatcaacttttaagggacgaagatgatacttctgtgactaccccatacactgcagccgtattggagtacagagtggtttaccatgataaaccagcagactcatatgctgaagatcaaacccatacaaacggtcatgttgttcatgatgcacagcatccttcaagatctaatgtggctttcaaaaaggaactacacacctctcaatcagataggtcttgtactcacttagaattcgatatttctcacacaggactgtcttacgaaactggcgatcacgttggcgtttattccgagaacttgtccgaagttgtcgatgaagcactaaaactgttagggttatcaccagacacatacttctcagtccatgctgataaggaggatgggacacctatcggtggtgcttcactaccaccaccttttcctccttgcacattgagagacgctctaaccagatacgcagatgtcttatcctcacctaaaaaggtagctttgctggcattggctgctcatgctagtgatcctagtgaagccgataggttaaagttcctggcttcaccagccggaaaagatgaatatgcacaatggatcgtcgccaaccaacgttctttgctagaagtgatgcaaagttttccatctgccaagcctccattaggtgtgttcttcgcagcagtagctccacgtttacaaccaagatactactctatcagttcatctcctaagatgtctcctaacagaatacatgttacatgtgctttggtgtacgagactactccagcaggcagaattcacagaggattgtgttcaacctggatgaaaaatgctgtccctttaacagagtcacctgattgctctcaagcatccattttcgttagaacatcaaatttcagacttccagtggatccaaaagttccagtcattatgataggaccaggcactggtcttgccccattcaggggctttcttcaagagagattggccttgaaggaatctggtacagaattgggttcttctatctttttctttggttgccgtaatagaaaagttgactttatctacgaggacgagcttaacaattttgttgagacaggagcattgtcagaattgatcgtcgcattttcaagagaagggactgccaaagagtacgttcagcacaagatgagtcaaaaagcctccgatatatggaaacttctaagtgaaggtgcctatctttatgtctgtggcgatgcaaagggcatggccaaggatgtccatagaactctgcatacaattgttcaggaacaagggagtctggattcttccaaggctgaattgtacgtcaaaaacttacagatgtctggaagatacttaagagatgtttggtaa

SEQ ID NO: 78 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 79 - DNA, 2106 bp, Siraitia grosvenorii
atgaaggtcagtccattcgaattcatgtccgctattatcaagggtagaatggacccatctaactcctcatttgaatctactggtgaagttgcctccgttatctttgaaaacagagaattggttgccatcttgaccacttctattgctgttatgattggttgcttcgttgtcttgatgtggagaagagctggttctagaaaggttaagaatgtcgaattgccaaagccattgattgtccatgaaccagaacctgaagttgaagatggtaagaagaaggtttccatcttcttcggtactcaaactggtactgctgaaggttttgctaaggctttggctgatgaagctaaagctagatacgaaaaggctaccttcagagttgttgatttggatgattatgctgccgatgatgaccaatacgaagaaaaattgaagaacgaatccttcgccgttttcttgttggctacttatggtgatggtgaacctactgataatgctgctagattttacaagtggttcgccgaaggtaaagaaagaggtgaatggttgcaaaacttgcactatgctgtttttggtttgggtaacagacaatacgaacacttcaacaagattgctaaggttgccgacgaattattggaagctcaaggtggtaatagattggttaaggttggtttaggtgatgacgatcaatgcatcgaagatgatttttctgcttggagagaatctttgtggccagaattggatatgttgttgagagatgaagatgatgctactactgttactactccatatactgctgctgtcttggaatacagagttgtctttcatgattctgctgatgttgctgctgaagataagtcttggattaacgctaatggtcatgctgttcatgatgctcaacatccattcagatctaacgttgtcgtcagaaaagaattgcatacttctgcctctgatagatcctgttctcatttggaattcaacatttccggttccgctttgaattacgaaactggtgatcatgttggtgtctactgtgaaaacttgactgaaactgttgatgaagccttgaacttgttgggtttgtctccagaaacttacttctctatctacaccgataacgaagatggtactccattgggtggttcttcattgccaccaccatttccatcatgtactttgagaactgctttgaccagatacgctgatttgttgaactctccaaaaaagtctgctttgttggctttagctgctcatgcttctaatccagttgaagctgatagattgagatacttggcttctccagctggtaaagatgaatatgcccaatctgttatcggttcccaaaagtctttgttggaagttatggctgaattcccatctgctaaaccaccattaggtgttttttttgctgctgttgctccaagattgcaacctagattctactccatttcatcctctccaagaatggctccatctagaatccatgttacttgtgctttggtttacgataagatgccaactggtagaattcataagggtgtttgttctacctggatgaagaattctgttccaatggaaaagtcccatgaatgttcttgggctccaattttcgttagacaatccaattttaagttgccagccgaatccaaggttccaattatcatggttggtccaggtactggtttggctccttttagaggttttttacaagaaagattggccttgaaagaatccggtgttgaattgggtccatccattttgtttttcggttgcagaaacagaagaatggattacatctacgaagatgaattgaacaacttcgttgaaaccggtgctttgtccgaattggttattgctttttctagagaaggtcctaccaaagaatacgtccaacataagatggctgaaaaggcttctgatatctggaacttgatttctgaaggtgcttacttgtacgtttgtggtgatgctaaaggtatggctaaggatgttcatagaaccttgcataccatcatgcaagaacaaggttctttggattcttccaaagctgaatccatggtcaagaacttgcaaatgaatggtagatacttaagagatgtttggtaa

SEQ ID NO: 80 - protein, 701 aa, Siraitia grosvenorii
MKVSPFEFMSAIIKGRMDPSNSSFESTGEVASVIFENRELVAILTTSIAVMIGCFVVLMWRRAGSRKVKNVELPKPLIVHEPEPEVEDGKKKVSIFFGTQTGTAEGFAKALADEAKARYEKATFRVVDLDDYAADDDQYEEKLKNESFAVFLLATYGDGEPTDNAARFYKWFAEGKERGEWLQNLHYAVFGLGNRQYEHFNKIAKVADELLEAQGGNRLVKVGLGDDDQCIEDDFSAWRESLWPELDMLLRDEDDATTVTTPYTAAVLEYRVVFHDSADVAAEDKSWINANGHAVHDAQHPFRSNVVVRKELHTSASDRSCSHLEFNISGSALNYETGDHVGVYCENLTETVDEALNLLGLSPETYFSIYTDNEDGTPLGGSSLPPPFPSCTLRTALTRYADLLNSPKKSALLALAAHASNPVEADRLRYLASPAGKDEYAQSVIGSQKSLLEVMAEFPSAKPPLGVFFAAVAPRLQPRFYSISSSPRMAPSRIHVTCALVYDKMPTGRIHKGVCSTWMKNSVPMEKSHECSWAPIFVRQSNFKLPAESKVPIIMVGPGTGLAPFRGFLQERLALKESGVELGPSILFFGCRNRRMDYIYEDELNNFVETGALSELVIAFSREGPTKEYVQHKMAEKASDIWNLISEGAYLYVCGDAKGMAKDVHRTLHTIMQEQGSLDSSKAESMVKNLQMNGRYLRDVW

SEQ ID NO: 81 - DNA, 2142 bp, Artificial Sequence
  Codon-optimized CPR
atggcagaattagatacacttgatatagtagtattaggtgttatctttttgggtactgtggcatactttactaagggtaaattgtggggtgttaccaaggatccatacgctaacggattcgctgcaggtggtgcttccaagcctggcagaactagaaacatcgtcgaagctatggaggaatcaggtaaaaactgtgttgttttctacggcagtcaaacaggtacagcggaggattacgcatcaagacttgcaaaggaaggaaagtccagattcggtttgaacactatgatcgccgatctagaagattatgacttcgataacttagacactgttccatctgataacatcgttatgtttgtattggctacttacggtgaaggcgaaccaacagataacgccgtggatttctatgagttcattactggcgaagatgcctctttcaatgagggcaacgatcctccactaggtaacttgaattacgttgcgttcggtctgggcaacaatacctacgaacactacaactcaatggtcaggaacgttaacaaggctctagaaaagttaggagctcatagaattggagaagcaggtgagggtgacgacggagctggaactatggaagaggactttttagcttggaaagatccaatgtgggaagccttggctaaaaagatgggcttggaggaaagagaagctgtatatgaacctattttcgctatcaatgagagagatgatttgacccctgaagcgaatgaggtatacttgggagaacctaataagctacacttggaaggtacagcgaaaggtccattcaactcccacaacccatatatcgcaccaattgcagaatcatacgaacttttctcagctaaggatagaaattgtctgcatatggaaattgatatttctggtagtaatctaaagtatgaaacaggcgaccatatcgcgatctggcctaccaacccaggtgaagaggtcaacaaatttcttgacattctagatctgtctggtaagcaacattccgtcgtaacagtgaaagccttagaacctacagccaaagttccttttccaaatccaactacctacgatgctatattgagataccatctggaaatatgcgctccagtttctagacagtttgtctcaactttagcagcattcgcccctaatgatgatatcaaagctgagatgaaccgtttgggatcagacaaagattacttccacgaaaagacaggaccacattactacaatatcgctagatttttggcctcagtctctaaaggtgaaaaatggacaaagataccattttctgctttcatagaaggccttacaaaactacaaccaagatactattctatctcttcctctagtttagttcagcctaaaaagattagtattactgctgttgtcgaatctcagcaaattccaggtagagatgacccattcagaggtgtagcgactaactacttgttcgctttgaagcagaaacaaaacggtgatccaaatccagctccttttggccaatcatacgagttgacaggaccaaggaataagtatgatggtatacatgttccagtccatgtaagacattctaactttaagctaccatctgatccaggcaaacctattatcatgatcggtccaggtaccggtgttgccccttttagaggcttcgtccaagagagggcaaaacaagccagagatggtgtagaagttggtaaaacactgctgttctttggatgtagaaagagtacagaagatttcatgtatcaaaaagagtggcaagagtacaaggaagctcttggcgacaaattcgaaatgattacagctttttcaagagaaggatctaaaaaggtttatgttcaacacagactgaaggaaagatcaaaggaagtttctgatcttctatcccaaaaagcatacttctacgtttgcggagacgccgcacatatggcacgtgaagtgaacactgtgttagcacagatcatagcagaaggccgtggtgtatcagaagccaagggtgaggaaattgtcaaaaacatgagatcagcaaatcaataccaagtgtgttctgatttcgtaactttacactgtaaagagacaacatacgcgaattcagaattgcaagaggatgtctggagttaa

SEQ ID NO: 82 - protein, 713 aa, Gibberella fujikuroi
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 83 - DNA, 2130 bp, Stevia rebaudiana
atgcaatcggaatccgttgaagcatcgacgattgatttgatgactgctgttttgaaggacacagtgatcgatacagcgaacgcatctgataacggagactcaaagatgccgccggcgttggcgatgatgttcgaaattcgtgatctgttgctgattttgactacgtcagttgctgttttggtcggatgtttcgttgttttggtgtggaagagatcgtccgggaagaagtccggcaaggaattggagccgccgaagatcgttgtgccgaagaggcggctggagcaggaggttgatgatggtaagaagaaggttacgattttcttcggaacacaaactggaacggctgaaggtttcgctaaggcacttttcgaagaagcgaaagcgcgatatgaaaaggcagcgtttaaagtgattgatttggatgattatgctgctgatttggatgagtatgcagagaagctgaagaaggaaacatatgctttcttcttcttggctacatatggagatggtgagccaactgataatgctgccaaattttataaatggtttactgagggagacgagaaaggcgtttggcttcaaaaacttcaatatggagtatttggtcttggcaacagacaatatgaacatttcaacaagattggaatagtggttgatgatggtctcaccgagcagggtgcaaaacgcattgttcccgttggtcttggagacgacgatcaatcaattgaagacgatttttcggcatggaaagagttagtgtggcccgaattggatctattgcttcgcgatgaagatgacaaagctgctgcaactccttacacagctgcaatccctgaataccgcgtcgtatttcatgacaaacccgatgcgttttctgatgatcatactcaaaccaatggtcatgctgttcatgatgctcaacatccatgcagatccaatgtggctgttaaaaaagagcttcatactcctgaatccgatcgttcatgcacacatcttgaatttgacatttctcacactggattatcttatgaaactggggatcatgttggtgtatactgtgaaaacctaattgaagtagtggaagaagctgggaaattgttaggattatcaacagatacttatttctcgttacatattgataacgaagatggttcaccacttggtggaccttcattacaacctccttttcctccttgtactttaagaaaagcattgactaattatgcagatctgttaagctctcccaaaaagtcaactttgcttgctctagctgctcatgcttccgatcccactgaagctgatcgtttaagatttcttgcatctcgcgagggcaaggatgaatatgctgaatgggttgttgcaaaccaaagaagtcttcttgaagtcatggaagctttcccgtcagctagaccgccacttggtgttttctttgcagcggttgcaccgcgtttacagcctcgttactactctatttcttcctccccaaagatggaaccaaacaggattcatgttacttgcgcgttggtttatgaaaaaactcccgcaggtcgtatccacaaaggaatctgctcaacctggatgaagaacgctgtacctttgaccgaaagtcaagattgcagttgggcaccgatttttgttagaacatcaaacttcagacttccaattgacccgaaagtcccggttatcatgattggtcctggaaccgggttggctccatttaggggttttcttcaagaaagattggctcttaaagaatccggaaccgaactcgggtcatctattttattcttcggttgtagaaaccgcaaagtggattacatatatgagaatgaactcaacaactttgttgaaaatggtgcgctttctgagcttgatgttgctttctcccgcgatggcccgacgaaagaatacgtgcaacataaaatgacccaaaaggcttctgaaatatggaatatgctttctgagggagcatatttatatgtatgtggtgatgctaaaggcatggctaaagatgtacaccgtacacttcacaccattgtgcaagaacagggaagtttggactcgtctaaagcggagttgtatgtgaagaatctacaaatgtcaggaagatacctccgtgatgtttggtaa

SEQ ID NO: 84 - protein, 709 aa, Stevia rebaudiana
MQSESVEASTIDLMTAVLKDTVIDTANASDNGDSKMPPALAMMFEIRDLLLILTTSVAVLVGCFVVLVWKRSSGKKSGKELEPPKIVVPKRRLEQEVDDGKKKVTIFFGTQTGTAEGFAKALFEEAKARYEKAAFKVIDLDDYAADLDEYAEKLKKETYAFFFLATYGDGEPTDNAAKFYKWFTEGDEKGVWLQKLQYGVFGLGNRQYEHFNKIGIVVDDGLTEQGAKRIVPVGLGDDDQSIEDDFSAWKELVWPELDLLLRDEDDKAAATPYTAAIPEYRVVFHDKPDAFSDDHTQTNGHAVHDAQHPCRSNVAVKKELHTPESDRSCTHLEFDISHTGLSYETGDHVGVYCENLIEVVEEAGKLLGLSTDTYFSLHIDNEDGSPLGGPSLQPPFPPCTLRKALTNYADLLSSPKKSTLLALAAHASDPTEADRLRFLASREGKDEYAEWVVANQRSLLEVMEAFPSARPPLGVFFAAVAPRLQPRYYSISSSPKMEPNRIHVTCALVYEKTPAGRIHKGICSTWMKNAVPLTESQDCSWAPIFVRTSNFRLPIDPKVPVIMIGPGTGLAPFRGFLQERLALKESGTELGSSILFFGCRNRKVDYIYENELNNFVENGALSELDVAFSRDGPTKEYVQHKMTQKASEIWNMLSEGAYLYVCGDAKGMAKDVHRTLHTIVQEQGSLDSSKAELYVKNLQMSGRYLRDVW

SEQ ID NO: 85 - DNA, 2124 bp, Artificial Sequence
  Codon-optimized CPR
atgcaatctaactccgtgaagatttcgccgcttgatctggtaactgcgctgtttagcggcaaggttttggacacatcgaacgcatcggaatcgggagaatctgctatgctgccgactatagcgatgattatggagaatcgtgagctgttgatgatactcacaacgtcggttgctgtattgatcggatgcgttgtcgttttggtgtggcggagatcgtctacgaagaagtcggcgttggagccaccggtgattgtggttccgaagagagtgcaagaggaggaagttgatgatggtaagaagaaagttacggttttcttcggcacccaaactggaacagctgaaggcttcgctaaggcacttgttgaggaagctaaagctcgatatgaaaaggctgtctttaaagtaattgatttggatgattatgctgctgatgacgatgagtatgaggagaaactaaagaaagaatctttggcctttttctttttggctacgtatggagatggtgagccaacagataatgctgccagattttataaatggtttactgagggagatgcgaaaggagaatggcttaataagcttcaatatggagtatttggtttgggtaacagacaatatgaacattttaacaagatcgcaaaagtggttgatgatggtcttgtagaacagggtgcaaagcgtcttgttcctgttggacttggagatgatgatcaatgtattgaagatgacttcaccgcatggaaagagttagtatggccggagttggatcaattacttcgtgatgaggatgacacaactgttgctactccatacacagctgctgttgcagaatatcgcgttgtttttcatgaaaaaccagacgcgctttctgaagattatagttatacaaatggccatgctgttcatgatgctcaacatccatgcagatccaacgtggctgtcaaaaaggaacttcatagtcctgaatctgaccggtcttgcactcatcttgaatttgacatctcgaacaccggactatcatatgaaactggggaccatgttggagtttactgtgaaaacttgagtgaagttgtgaatgatgctgaaagattagtaggattaccaccagacacttactcctccatccacactgatagtgaagacgggtcgccacttggcggagcctcattgccgcctcctttcccgccatgcactttaaggaaagcattgacgtgttatgctgatgttttgagttctcccaagaagtcggctttgcttgcactagctgctcatgccaccgatcccagtgaagctgatagattgaaatttcttgcatcccccgccggaaaggatgaatattctcaatggatagttgcaagccaaagaagtctccttgaagtcatggaagcattcccgtcagctaagccttcacttggtgttttctttgcatctgttgccccgcgcttacaaccaagatactactctatttcttcctcacccaagatggcaccggataggattcatgttacatgtgcattagtctatgagaaaacacctgcaggccgcatccacaaaggagtttgttcaacttggatgaagaacgcagtgcctatgaccgagagtcaagattgcagttgggccccaatatacgtccgaacatccaatttcagactaccatctgaccctaaggtcccggttatcatgattggacctggcactggtttggctccttttagaggtttccttcaagagcggttagctttaaaggaagccggaactgacctcggtttatccattttattcttcggatgtaggaatcgcaaagtggatttcatatatgaaaacgagcttaacaactttgtggagactggtgctctttctgagcttattgttgctttctcccgtgaaggcccgactaaggaatatgtgcaacacaagatgagtgagaaggcttcggatatctggaacttgctttctgaaggagcatatttatacgtatgtggtgatgccaaaggcatggccaaagatgtacatcgaaccctccacacaattgtgcaagaacagggatctcttgactcgtcaaaggcagaactctacgtgaagaatctacaaatgtcaggaagatacctccgtgacgtttggtaa

SEQ ID NO: 86 - protein, 707 aa, Stevia rebaudiana
MQSNSVKISPLDLVTALFSGKVLDTSNASESGESAMLPTIAMIMENRELLMILTTSVAVLIGCVVVLVWRRSSTKKSALEPPVIVVPKRVQEEEVDDGKKKVTVFFGTQTGTAEGFAKALVEEAKARYEKAVFKVIDLDDYAADDDEYEEKLKKESLAFFFLATYGDGEPTDNAARFYKWFTEGDAKGEWLNKLQYGVFGLGNRQYEHFNKIAKVVDDGLVEQGAKRLVPVGLGDDDQCIEDDFTAWKELVWPELDQLLRDEDDTTVATPYTAAVAEYRVVFHEKPDALSEDYSYTNGHAVHDAQHPCRSNVAVKKELHSPESDRSCTHLEFDISNTGLSYETGDHVGVYCENLSEVVNDAERLVGLPPDTYSSIHTDSEDGSPLGGASLPPPFPPCTLRKALTCYADVLSSPKKSALLALAAHATDPSEADRLKFLASPAGKDEYSQWIVASQRSLLEVMEAFPSAKPSLGVFFASVAPRLQPRYYSISSSPKMAPDRIHVTCALVYEKTPAGRIHKGVCSTWMKNAVPMTESQDCSWAPIYVRTSNFRLPSDPKVPVIMIGPGTGLAPFRGFLQERLALKEAGTDLGLSILFFGCRNRKVDFIYENELNNFVETGALSELIVAFSREGPTKEYVQHKMSEKASDIWNLLSEGAYLYVCGDAKGMAKDVHRTLHTIVQEQGSLDSSKAELYVKNLQMSGRYLRDVW

SEQ ID NO: 87 - DNA, 2070 bp, Artificial Sequence
  Codon-optimized CPR
atgtcctccaactccgatttggtcagaagattggaatctgttttgggtgtttctttcggtggttctgttactgattccgttgttgttattgctaccacctctattgctttggttatcggtgttttggttttgttgtggagaagatcctctgacagatctagagaagttaagcaattggctgttccaaagccagttactatcgttgaagaagaagatgaattcgaagttgcttctggtaagaccagagtttctattttctacggtactcaaactggtactgctgaaggttttgctaaggctttggctgaagaaatcaaagccagatacgaaaaagctgccgttaaggttattgatttggatgattacacagccgaagatgacaaatacggtgaaaagttgaagaaagaaactatggccttcttcatgttggctacttatggtgatggtgaacctactgataatgctgctagattttacaagtggttcaccgaaggtactgatagaggtgtttggttggaacatttgagatacggtgtattcggtttgggtaacagacaatacgaacacttcaacaagattgccaaggttgttgatgatttgttggttgaacaaggtgccaagagattggttactgttggtttgggtgatgatgatcaatgcatcgaagatgatttctccgcttggaaagaagccttgtggccagaattggatcaattattgcaagatgataccaacaccgtttctactccatacactgctgttattccagaatacagagttgttatccacgatccatctgttacctcttatgaagatccatactctaacatggctaacggtaatgcctcttacgatattcatcatccatgtagagctaacgttgccgtccaaaaagaattgcataagccagaatctgacagaagttgcatccatttggaattcgatattttcgctactggtttgacttacgaaaccggtgatcatgttggtgtttacgctgataattgtgatgatactgtagaagaagccgctaagttgttgggtcaaccattggatttgttgttctccattcataccgataacaacgacggtacttctttgggttcttctttgccaccaccatttccaggtccatgtactttgagaactgctttggctagatatgccgatttgttgaatccaccaaaaaaggctgctttgattgctttagctgctcatgctgatgaaccatctgaagctgaaagattgaagttcttgtcatctccacaaggtaaggacgaatattctaaatgggttgtcggttcccaaagatccttggttgaagttatggctgaatttccatctgctaaaccaccattgggtgtattttttgctgctgttgttcctagattgcaacctagatattactccatctcttccagtccaagatttgctccacatagagttcatgttacttgcgctttggtttatggtccaactccaactggtagaattcacagaggtgtatgttcattctggatgaagaatgttgtcccattggaaaagtctcaaaactgttcttgggccccaattttcatcagacaatctaatttcaagttgccagccgatcattctgttccaatagttatggttggtccaggtactggtttagctccttttagaggtttcttacaagaaagattggccttgaaagaagaaggtgctcaagttggtcctgctttgttgttttttggttgcagaaacagacaaatggacttcatctacgaagtcgaattgaacaactttgtcgaacaaggtgctttgtccgaattgatcgttgctttttcaagagaaggtccatccaaagaatacgtccaacataagatggttgaaaaggcagcttacatgtggaacttgatttctcaaggtggttacttctacgtttgtggtgatgctaaaggtatggctagagatgttcatagaacattgcataccatcgtccaacaagaagaaaaggttgattctaccaaggccgaatccatcgttaagaaattgcaaatggacggtagatacttgagagatgtttggtga

SEQ ID NO: 88 - protein, 689 aa, Rubus suavissimus
MSSNSDLVRRLESVLGVSFGGSVTDSVVVIATTSIALVIGVLVLLWRRSSDRSREVKQLAVPKPVTIVEEEDEFEVASGKTRVSIFYGTQTGTAEGFAKALAEEIKARYEKAAVKVIDLDDYTAEDDKYGEKLKKETMAFFMLATYGDGEPTDNAARFYKWFTEGTDRGVWLEHLRYGVFGLGNRQYEHFNKIAKVVDDLLVEQGAKRLVTVGLGDDDQCIEDDFSAWKEALWPELDQLLQDDTNTVSTPYTAVIPEYRVVIHDPSVTSYEDPYSNMANGNASYDIHHPCRANVAVQKELHKPESDRSCIHLEFDIFATGLTYETGDHVGVYADNCDDTVEEAAKLLGQPLDLLFSIHTDNNDGTSLGSSLPPPFPGPCTLRTALARYADLLNPPKKAALIALAAHADEPSEAERLKFLSSPQGKDEYSKWVVGSQRSLVEVMAEFPSAKPPLGVFFAAVVPRLQPRYYSISSSPRFAPHRVHVTCALVYGPTPTGRIHRGVCSFWMKNVVPLEKSQNCSWAPIFIRQSNFKLPADHSVPIVMVGPGTGLAPFRGFLQERLALKEEGAQVGPALLFFGCRNRQMDFIYEVELNNFVEQGALSELIVAFSREGPSKEYVQHKMVEKAAYMWNLISQGGYFYVCGDAKGMARDVHRTLHTIVQQEEKVDSTKAESIVKKLQMDGRYLRDVW

SEQ ID NO: 89 - DNA, 2079 bp, Artificial Sequence
  Codon-optimized CPR
atgacttctgcactttatgcctccgatcttttcaaacaattgaaaagtatcatgggaacggattctttgtccgatgatgttgtattagttattgctacaacttctctggcactggttgctggtttcgttgtcttattgtggaaaaagaccacggcagatcgttccggcgagctaaagccactaatgatccctaagtctctgatggcgaaagatgaggatgatgacttagatctaggttctggaaaaacgagagtctctatcttcttcggcacacaaaccggaacagccgaaggattcgctaaagcactttcagaagagatcaaagcaagatacgaaaaggcggctgtaaaagtaatcgatttggatgattacgctgccgatgatgaccaatatgaggaaaagttgaaaaaggaaacattggctttcttttgtgtagccacgtatggtgatggtgaaccaaccgataacgccgcaagattctacaagtggtttactgaagagaacgaaagagatatcaagttgcagcaacttgcttacggcgtttttgccttaggtaacagacaatacgagcactttaacaagataggtattgtcttagatgaagagttatgcaaaaagggtgcgaagagattgattgaagtcggtttaggagatgatgatcaatctatcgaggatgactttaatgcatggaaggaatctttgtggtctgaattagataagttacttaaggacgaagatgataaatccgttgccactccatacacagccgtcattccagaatatagagtagttactcatgatccaagattcacaacacagaaatcaatggaaagtaatgtggctaatggtaatactaccatcgatattcatcatccatgtagagtagacgttgcagttcaaaaggaattgcacactcatgaatcagacagatcttgcatacatcttgaatttgatatatcacgtactggtatcacttacgaaacaggtgatcacgtgggtgtctacgctgaaaaccatgttgaaattgtagaggaagctggaaagttgttgggccatagtttagatcttgttttctcaattcatgccgataaagaggatggctcaccactagaaagtgcagtgcctccaccatttccaggaccatgcaccctaggtaccggtttagctcgttacgcggatctgttaaatcctccacgtaaatcagctctagtggccttggctgcgtacgccacagaaccttctgaggcagaaaaactgaaacatctaacttcaccagatggtaaggatgaatactcacaatggatagtagctagtcaacgttctttactagaagttatggctgctttcccatccgctaaacctcctttgggtgttttcttcgccgcaatagcgcctagactgcaaccaagatactattcaatttcatcctcacctagactggcaccatcaagagttcatgtcacatccgctttagtgtacggtccaactcctactggtagaatccataagggcgtttgttcaacatggatgaaaaacgcggttccagcagagaagtctcacgaatgttctggtgctccaatctttatcagagcctccaacttcaaactgccttccaatccttctactcctattgtcatggtcggtcctggtacaggtcttgctccattcagaggtttcttacaagagagaatggccttaaaggaggatggtgaagagttgggatcttctttgttgtttttcggctgtagaaacagacaaatggatttcatctacgaagatgaactgaataactttgtagatcaaggagttatttcagagttgataatggctttttctagagaaggtgctcagaaggagtacgtccaacacaaaatgatggaaaaggccgcacaagtttgggacttaatcaaagaggaaggctatctatatgtctgtggtgatgcaaagggtatggcaagagatgttcacagaacacttcatactatagtccaggaacaggaaggcgttagttcttctgaagcggaagcaattgtgaaaaagttacaaacagagggaagatacttgagagatgtgtggtaa

SEQ ID NO: 90 - protein, 692 aa, Arabidopsis thaliana [sequence omitted]

SEQ ID NO: 91 - DNA, 2139 bp, Artificial Sequence
  Codon-optimized CPR
atgtcttcctcttcctcttccagtacctctatgattgatttgatggctgctattattaaaggtgaaccagttatcgtctccgacccagcaaatgcctctgcttatgaatcagttgctgcagaattgtcttcaatgttgatcgaaaacagacaattcgccatgatcgtaactacatcaatcgctgttttgatcggttgtattgtcatgttggtatggagaagatccggtagtggtaattctaaaagagtcgaacctttgaaaccattagtaattaagccaagagaagaagaaatagatgacggtagaaagaaagttacaatatttttcggtacccaaactggtacagctgaaggttttgcaaaagccttaggtgaagaagctaaggcaagatacgaaaagactagattcaagatagtcgatttggatgactatgccgctgatgacgatgaatacgaagaaaagttgaagaaagaagatgttgcatttttctttttggcaacctatggtgacggtgaaccaactgacaatgcagccagattctacaaatggtttacagagggtaatgatcgtggtgaatggttgaaaaacttaaagtacggtgttttcggtttgggtaacagacaatacgaacatttcaacaaagttgcaaaggttgtcgacgatattttggtcgaacaaggtgctcaaagattagtccaagtaggtttgggtgacgatgaccaatgtatagaagatgactttactgcctggagagaagctttgtggcctgaattagacacaatcttgagagaagaaggtgacaccgccgttgctaccccatatactgctgcagtattagaatacagagtttccatccatgatagtgaagacgcaaagtttaatgatatcactttggccaatggtaacggttatacagttttcgatgcacaacacccttacaaagctaacgttgcagtcaagagagaattacatacaccagaatccgacagaagttgtatacacttggaatttgatatcgctggttccggtttaaccatgaagttgggtgaccatgtaggtgttttatgcgacaatttgtctgaaactgttgatgaagcattgagattgttggatatgtcccctgacacttattttagtttgcacgctgaaaaagaagatggtacaccaatttccagttctttaccacctccattccctccatgtaacttaagaacagccttgaccagatacgcttgcttgttatcatcccctaaaaagtccgccttggttgctttagccgctcatgctagtgatcctactgaagcagaaagattgaaacacttagcatctccagccggtaaagatgaatattcaaagtgggtagttgaatctcaaagatcattgttagaagttatggcagaatttccatctgccaagcctccattaggtgtcttctttgctggtgtagcacctagattgcaaccaagattctactcaatcagttcttcacctaagatcgctgaaactagaattcatgttacatgtgcattagtctacgaaaagatgccaaccggtagaattcacaagggtgtatgctctacttggatgaaaaatgctgttccttacgaaaaatcagaaaagttgttcttaggtagaccaatcttcgtaagacaatcaaacttcaagttgccttctgattcaaaggttccaataatcatgataggtcctggtacaggtttagccccattcagaggtttcttgcaagaaagattggctttagttgaatctggtgtcgaattaggtccttcagttttgttctttggttgtagaaacagaagaatggatttcatctatgaagaagaattgcaaagattcgtcgaatctggtgcattggccgaattatctgtagctttttcaagagaaggtccaactaaggaatacgttcaacataagatgatggataaggcatccgacatatggaacatgatcagtcaaggtgcttatttgtacgtttgcggtgacgcaaagggtatggccagagatgtccatagatctttgcacacaattgctcaagaacaaggttccatggatagtaccaaagctgaaggtttcgtaaagaacttacaaacttccggtagatacttgagagatgtctggtga

SEQ ID NO: 92 - protein, 712 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 93 - DNA, 1503 bp, Artificial Sequence
  Codon-optimized KAH
atggaagcctcttacctatacatttctattttgcttttactggcatcatacctgttcaccactcaacttagaaggaagagcgctaatctaccaccaaccgtgtttccatcaataccaatcattggacacttatacttactcaaaaagcctctttatagaactttagcaaaaattgccgctaagtacggaccaatactgcaattacaactcggctacagacgtgttctggtgatttcctcaccatcagcagcagaagagtgctttaccaataacgatgtaatcttcgcaaatagacctaagacattgtttggcaaaatagtgggtggaacatcccttggcagtttatcctacggcgatcaatggcgtaatctaaggagagtagcttctatcgaaatcctatcagttcataggttgaacgaatttcatgatatcagagtggatgagaacagattgttaattagaaaacttagaagttcatcttctcctgttactcttataacagtcttttatgctctaacattgaacgtcattatgagaatgatctctggcaaaagatatttcgacagtggggatagagaattggaggaggaaggtaagagatttcgagaaatcttagacgaaacgttgcttctagccggtgcttctaatgttggcgactacttaccaatattgaactggttgggagttaagtctcttgaaaagaaattgatcgctttgcagaaaaagagagatgactttttccagggtttgattgaacaggttagaaaatctcgtggtgctaaagtaggcaaaggtagaaaaacgatgatcgaactcttattatctttgcaagagtcagaacctgagtactatacagatgctatgataagatcttttgtcctaggtctgctggctgcaggtagtgatacttcagcgggcactatggaatgggccatgagcttactggtcaatcacccacatgtattgaagaaagctcaagctgaaatcgatagagttatcggtaataacagattgattgacgagtcagacattggaaatatcccttacatcgggtgtattatcaatgaaactctaagactctatccagcagggccattgttgttcccacatgaaagttctgccgactgcgttatttccggttacaatatacctagaggtacaatgttaatcgtaaaccaatgggcgattcatcacgatcctaaagtctgggatgatcctgaaacctttaaacctgaaagatttcaaggattagaaggaactagagatggtttcaaacttatgccattcggttctgggagaagaggatgtccaggtgaaggtttggcaataaggctgttagggatgacactaggctcagtgatccaatgttttgattgggagagagtaggagatgagatggttgacatgacagaaggtttgggtgtcacacttcctaaggccgttccattagttgccaaatgtaagccacgttccgaaatgactaatctcctatccgaactttaa

SEQ ID NO: 94 - protein, 500 aa, Stevia rebaudiana
MEASYLYISILLLLASYLFTTQLRRKSANLPPTVFPSIPIIGHLYLLKKPLYRTLAKIAAKYGPILQLQLGYRRVLVISSPSAAEECFTNNDVIFANRPKTLFGKIVGGTSLGSLSYGDQWRNLRRVASIEILSVHRLNEFHDIRVDENRLLIRKLRSSSSPVTLITVFYALTLNVIMRMISGKRYFDSGDRELEEEGKRFREILDETLLLAGASNVGDYLPILNWLGVKSLEKKLIALQKKRDDFFQGLIEQVRKSRGAKVGKGRKTMIELLLSLQESEPEYYTDAMIRSFVLGLLAAGSDTSAGTMEWAMSLLVNHPHVLKKAQAEIDRVIGNNRLIDESDIGNIPYIGCIINETLRLYPAGPLLFPHESSADCVISGYNIPRGTMLIVNQWAIHHDPKVWDDPETFKPERFQGLEGTRDGFKLMPFGSGRRGCPGEGLAIRLLGMTLGSVIQCFDWERVGDEMVDMTEGLGVTLPKAVPLVAKCKPRSEMTNLLSEL

SEQ ID NO: 95 - DNA, 1572 bp, Rubus suavissimus
atggaagtaacagtagctagtagtgtagccctgagcctggtctttattagcatagtagtaagatgggcatggagtgtggtgaattgggtgtggtttaagccgaagaagctggaaagatttttgagggagcaaggccttaaaggcaattcctacaggtttttatatggagacatgaaggagaactctatcctgctcaaacaagcaagatccaaacccatgaacctctccacctcccatgacatagcacctcaagtcaccccttttgtcgaccaaaccgtgaaagcttacggtaagaactcttttaattgggttggccccataccaagggtgaacataatgaatccagaagatttgaaggacgtcttaacaaaaaatgttgactttgttaagccaatatcaaacccacttatcaagttgctagctacaggtattgcaatctatgaaggtgagaaatggactaaacacagaaggattatcaacccaacattccattcggagaggctaaagcgtatgttaccttcatttcaccaaagttgtaatgagatggtcaaggaatgggagagcttggtgtcaaaagagggttcatcatgtgagttggatgtctggccttttcttgaaaatatgtcggcagatgtgatctcgagaacagcatttggaactagctacaaaaaaggacagaaaatctttgaactcttgagagagcaagtaatatatgtaacgaaaggctttcaaagtttttacattccaggatggaggtttctcccaactaagatgaacaagaggatgaatgagattaacgaagaaataaaaggattaatcaggggtattataattgacagagagcaaatcattaaggcaggtgaagaaaccaacgatgacttattaggtgcacttatggagtcaaacttgaaggacattcgggaacatgggaaaaacaacaaaaatgttgggatgagtattgaagatgtaattcaggagtgtaagctgttttactttgctgggcaagaaaccacttcagtgttgctggcttggacaatggttttacttggtcaaaatcagaactggcaagatcgagcaagacaagaggttttgcaagtctttggaagcagcaagccagattttgatggtctagctcaccttaaagtcgtaaccatgattttgcttgaagttcttcgattatacccaccagtcattgaacttattcgaaccattcacaagaaaacacaacttgggaagctctcactaccagaaggagttgaagtccgcttaccaacactgctcattcaccatgacaaggaactgtggggtgatgatgcaaaccagttcaatccagagaggttttcggaaggagtttccaaagcaacaaagaaccgactctcattcttccccttcggagccggtccacgcatttgcattggacagaacttttctatgatggaagcaaagttggccttagcattgatcttgcaacacttcacctttgagctttctccatctcatgcacatgctccttcccatcgtataacccttcaaccacagtatggtgttcgtatcattttacatcgacgttag

SEQ ID NO: 96 - DNA, 1572 bp, Artificial Sequence
  Codon-optimized KAH
atggaagtcactgtcgcctcttctgtcgctttatccttagtcttcatttccattgtcgtcagatgggcttggtccgttgtcaactgggtttggttcaaaccaaagaagttggaaagattcttgagagagcaaggtttgaagggtaattcttatagattcttgtacggtgacatgaaggaaaattctattttgttgaagcaagccagatccaaaccaatgaacttgtctacctctcatgatattgctccacaagttactccattcgtcgatcaaactgttaaagcctacggtaagaactctttcaattgggttggtccaattcctagagttaacatcatgaacccagaagatttgaaggatgtcttgaccaagaacgttgacttcgttaagccaatttccaacccattgattaaattgttggctactggtattgccatttacgaaggtgaaaagtggactaagcatagaagaatcatcaaccctaccttccactctgaaagattgaagagaatgttaccatctttccatcaatcctgtaatgaaatggttaaggaatgggaatccttggtttctaaagaaggttcttcttgcgaattggatgtttggccattcttggaaaatatgtctgctgatgtcatttccagaaccgctttcggtacctcctacaagaagggtcaaaagattttcgaattgttgagagagcaagttatttacgttaccaagggtttccaatccttctacatcccaggttggagattcttgccaactaaaatgaacaagcgtatgaacgagatcaacgaagaaattaaaggtttgatcagaggtattattatcgacagagaacaaattattaaagctggtgaagaaaccaacgatgatttgttgggtgctttgatggagtccaacttgaaggatattagagaacatggtaagaacaacaagaatgttggtatgtctattgaagatgttattcaagaatgtaagttattctacttcgctggtcaagagaccacttctgttttgttagcctggactatggtcttgttaggtcaaaaccaaaattggcaagatagagctagacaagaagttttgcaagtcttcggttcttccaagccagactttgatggtttggcccacttgaaggttgttactatgattttgttagaagttttgagattgtacccaccagtcattgagttaatcagaaccattcataaaaagactcaattgggtaaattatctttgccagaaggtgttgaagtcagattaccaaccttgttgattcaccacgataaggaattatggggtgacgacgctaatcaatttaatccagaaagattttccgaaggtgtttccaaggctaccaaaaaccgtttgtccttcttcccatttggtgctggtccacgtatttgtatcggtcaaaacttttccatgatggaagccaagttggctttggctttaatcttgcaacacttcactttcgaattgtctccatcccatgcccacgctccttctcatagaatcactttacaaccacaatacggtgtcagaatcatcttacacagaagataa

SEQ ID NO: 97 - protein, 523 aa, Rubus suavissimus
MEVTVASSVALSLVFISIVVRWAWSVVNWVWFKPKKLERFLREQGLKGNSYRFLYGDMKENSILLKQARSKPMNLSTSHDIAPQVTPFVDQTVKAYGKNSFNWVGPIPRVNIMNPEDLKDVLTKNVDFVKPISNPLIKLLATGIAIYEGEKWTKHRRIINPTFHSERLKRMLPSFHQSCNEMVKEWESLVSKEGSSCELDVWPFLENMSADVISRTAFGTSYKKGQKIFELLREQVIYVTKGFQSFYIPGWRFLPTKMNKRMNEINEEIKGLIRGIIIDREQIIKAGEETNDDLLGALMESNLKDIREHGKNNKNVGMSIEDVIQECKLFYFAGQETTSVLLAWTMVLLGQNQNWQDRARQEVLQVFGSSKPDFDGLAHLKVVTMILLEVLRLYPPVIELIRTIHKKTQLGKLSLPEGVEVRLPTLLIHHDKELWGDDANQFNPERFSEGVSKATKNRLSFFPFGAGPRICIGQNFSMMEAKLALALILQHFTFELSPSHAHAPSHRITLQPQYGVRIILHRR

SEQ ID NO: 98 - DNA, 1566 bp, Prunus avium
atggaagcatcaagggctagttgtgttgcgctatgtgttgtttgggtgagcatagtaattacattggcatggagggtgctgaattgggtgtggttgaggccaaagaaactagaaagatgcttgagggagcaaggccttacaggcaattcttacaggcttttgtttggagacaccaaggatctctcgaagatgctggaacaaacacaatccaaacccatcaaactctccacctcccatgatatagcgccacgagtcaccccatttttccatcgaactgtgaactctaatggcaagaattcttttgtttggatgggccctataccaagagtgcacatcatgaatccagaagatttgaaagatgccttcaacagacatgatgattttcataagacagtaaaaaatcctatcatgaagtctccaccaccgggcattgtaggcattgaaggtgagcaatgggctaaacacagaaagattatcaacccagcattccatttagagaagctaaagggtatggtaccaatattttaccaaagttgtagcgagatgattaacaaatgggagagcttggtgtccaaagagagttcatgtgagttggatgtgtggccttatcttgaaaattttaccagcgatgtgatttcccgagctgcatttggaagtagctatgaagagggaaggaaaatatttcaactactaagagaggaagcaaaagtttattcggtagctctacgaagtgtttacattccaggatggaggtttctaccaaccaagcagaacaagaagacgaaggaaattcacaatgaaattaaaggcttacttaagggcattataaataaaagggaagaggcgatgaaggcaggggaagccactaaagatgacttactaggaatacttatggagtccaacttcagggaaattcaggaacatgggaacaacaaaaatgctggaatgagtattgaagatgtaattggagagtgtaagttgttttactttgctgggcaagagaccacttcggtgttgcttgtttggacaatgattttactaagccaaaatcaggattggcaagctcgtgcaagagaagaggtcttgaaagtctttggaagcaacatcccaacctatgaagagctaagtcacctaaaagttgtgaccatgattttacttgaagttcttcgattatacccatcagtcgttgcgcttcctcgaaccactcacaagaaaacacagcttggaaaattatcattaccagctggagtggaagtctccttgcccatactgcttgttcaccatgacaaagagttgtggggtgaggatgcaaatgagttcaagccagagaggttttcagagggagtttcaaaggcaacaaagaacaaatttacatacttacctttcggagggggtccaaggatttgcattggacaaaactttgccatggtggaagctaaattggccttggccctgattttacaacactttgcctttgagctttctccatcctatgctcatgctccttctgcagttataacccttcaacctcaatttggtgctcatatcattttgcataaacgttga

SEQ ID NO: 99 - DNA, 1567 bp, Artificial Sequence
  Codon-optimized KAH
atggaagcttctagagcatcttgtgttgctttgtgtgttgtttgggtttccatcgttattactttggcttggagagttttgaattgggtctggttaagaccaaaaaagttggaaagatgcttgagagaacaaggtttgactggtaactcttacagattgttgttcggtgataccaaggacttgtctaagatgttggaacaaactcaatccaagcctatcaagttgtctacctctcatgatattgctccaagagttactccattcttccatagaactgttaactccaacggtaagaactcttttgtttggatgggtccaattccaagagtccatattatgaaccctgaagatttgaaggacgctttcaacagacatgatgatttccataagaccgtcaagaacccaattatgaagtctccaccaccaggtatagttggtattgaaggtgaacaatgggccaaacatagaaagattattaacccagccttccacttggaaaagttgaaaggtatggttccaatcttctaccaatcctgctctgaaatgattaacaagtgggaatccttggtttccaaagaatcttcctgtgaattggatgtctggccatatttggaaaacttcacctccgatgttatttccagagctgcttttggttcttcttacgaagaaggtagaaagatcttccaattattgagagaagaagccaaggtttactccgttgctttgagatctgtttacattccaggttggagattcttgccaactaagcaaaacaaaaagaccaaagaaatccacaacgaaatcaagggtttgttgaagggtatcatcaacaagagagaagaagctatgaaggctggtgaagctacaaaagatgatttgttgggtatcttgatggaatccaacttcagagaaatccaagaacacggtaacaacaagaatgccggtatgtctattgaagatgttatcggtgaatgcaagttgttctactttgctggtcaagaaactacctccgttttgttggtttggaccatgattttgttgtcccaaaatcaagattggcaagctagagctagagaagaagtcttgaaagttttcggttctaacatcccaacctacgaagaattgtctcacttgaaggttgtcactatgatcttgttggaagtattgagattatacccatccgttgttgcattgccaagaactactcataagaaaactcaattgggtaaattgtccttgccagctggtgttgaagtttctttgccaattttgttagtccaccacgacaaagaattgtggggtgaagatgctaatgaattcaagccagaaagattctccgaaggtgtttctaaagctaccaagaacaagttcacttacttgccatttggtggtggtccaagaatatgtattggtcaaaatttcgctatggtcgaagctaaattggctttggctttgatcttgcaacatttcgctttcgaattgtcaccatcttatgctcatgctccatctgctgttattacattgcaaccacaatttggtgcccatatcatcttgcataagagataac

SEQ ID NO: 100 - protein, 521 aa, Prunus avium
MEASRASCVALCVVWVSIVITLAWRVLNWVWLRPKKLERCLREQGLTGNSYRLLFGDTKDLSKMLEQTQSKPIKLSTSHDIAPRVTPFFHRTVNSNGKNSFVWMGPIPRVHIMNPEDLKDAFNRHDDFHKTVKNPIMKSPPPGIVGIEGEQWAKHRKIINPAFHLEKLKGMVPIFYQSCSEMINKWESLVSKESSCELDVWPYLENFTSDVISRAAFGSSYEEGRKIFQLLREEAKVYSVALRSVYIPGWRFLPTKQNKKTKEIHNEIKGLLKGIINKREEAMKAGEATKDDLLGILMESNFREIQEHGNNKNAGMSIEDVIGECKLFYFAGQETTSVLLVWTMILLSQNQDWQARAREEVLKVFGSNIPTYEELSHLKVVTMILLEVLRLYPSVVALPRTTHKKTQLGKLSLPAGVEVSLPILLVHHDKELWGEDANEFKPERFSEGVSKATKNKFTYLPFGGGPRICIGQNFAMVEAKLALALILQHFAFELSPSYAHAPSAVITLQPQFGAHIILHKR

SEQ ID NO: 101 - protein, 517 aa, Prunus mume
ASWVAVLSVVWVSMVIAWAWRVLNWVWLRPKKLEKCLREQGLAGNSYRLLFGDTKDLSKMLEQTQSKPIKLSTSHDIAPHVTPFFHQTVNSYGKNSFVWMGPIPRVHIMNPEDLKDTFNRHDDFHKVVKNPIMKSLPQGIVGIEGEQWAKHRKIINPAFHLEKLKGMVPIFYRSCSEMINKWESLVSKESSCELDVWPYLENFTSDVISRAAFGSSYEEGRKIFQLLREEAKIYTVAMRSVYIPGWRFLPTKQNKKAKEIHNEIKGLLKGIINKREEAMKAGEATKDDLLGILMESNFREIQEHGNNKNAGMSIEDVIGECKLFYFAGQETTSVLLVWTMVLLSQNQDWQARAREEVLQVFGSNIPTYEELSQLKVVTMILLEVLRLYPSVVALPRTTHKKTQLGKLSLPAGVEVSLPILLVHHDKELWGEDANEFKPERFSEGVSKATKNQFTYFPFGGGPRICIGQNFAMMEAKLALSLILRHFALELSPLYAHAPSVTITLQPQYGAHIILHKR

SEQ ID NO: 102 - protein, 521 aa, Prunus mume
MEASRPSCVALSVVLVSIVIAWAWRVLNWVWLRPNKLERCLREQGLTGNSYRLLFGDTKEISMMVEQAQSKPIKLSTTHDIAPRVIPFSHQIVYTYGRNSFVWMGPTPRVTIMNPEDLKDAFNKSDEFQRAISNPIVKSISQGLSSLEGEKWAKHRKIINPAFHLEKLKGMLPTFYQSCSEMINKWESLVFKEGSREMDVWPYLENLTSDVISRAAFGSSYEEGRKIFQLLREEAKFYTIAARSVYIPGWRFLPTKQNKRMKEIHKEVRGLLKGIINKREDAIKAGEAAKGNLLGILMESNFREIQEHGNNKNAGMSIEDVIGECKLFYFAGQETTSVLLVWTLVLLSQNQDWQARAREEVLQVFGTNIPTYDQLSHLKVVTMILLEVLRLYPAVVELPRTTYKKTQLGKFLLPAGVEVSLHIMLAHHDKELWGEDAKEFKPERFSEGVSKATKNQFTYFPFGAGPRICIGQNFAMLEAKLALSLILQHFTFELSPSYAHAPSVTITLHPQFGAHFILHKR

SEQ ID NO: 103 - protein, 514 aa, Prunus mume
CVALSVVLVSIVIAWAWRVLNWVWLRPNKLERCLREQGLTGNSYRLLFGDTKEISMMVEQAQSKPIKLSTTHDIAPRVIPFSHQIVYTYGRNSFVWMGPTPRVTIMNPEDLKDAFNKSDEFQRAISNPIVKSISQGLSSLEGEKWAKHRKIINPAFHLEKLKGMLPTFYQSCSEMINKWESLVFKEGSREMDVWPYLENLTSDVISRAAFGSSYEEGRKIFQLLREEAKFYTIAARSVYIPGWRFLPTKQNKRMKEIHKEVRGLLKGIINKREDAIKAGEAAKGNLLGILMESNFREIQEHGNNKNAGMSIEDVIGECKLFYFAGQETTSVLLVWTLVLLSQNQDWQARAREEVLQVFGTNIPTYDQLSHLKVVTMILLEVLRLYPAVVELPRTTYKKTQLGKFLLPAGVEVSLHIMLAHHDKELWGEDAKEFKPERFSEGVSKATKNQFTYFPFGAGPRICIGQNFAMLEAKLALSLILQHFTFELSPSYAHAPSVTITLHPQFGAHFILHKR

SEQ ID NO: 104 - protein, 418 aa, Prunus persica
MGPIPRVHIMNPEDLKDTFNRHDDFHKVVKNPIMKSLPQGIVGIEGDQWAKHRKIINPAFHLEKLKGMVPIFYQSCSEMINIWKSLVSKESSCELDVWPYLENFTSDVISRAAFGSSYEEGRKIFQLLREEAKVYTVAVRSVYIPGWRFLPTKQNKKTKEIHNEIKGLLKGIINKREEAMKAGEATKDDLLGILMESNFREIQEHGNNKNAGMSIEDVIGECKLFYFAGQETTSVLLVWTMVLLSQNQDWQARAREEVLQVFGSNIPTYEELSHLKVVTMILLEVLRLYPSVVALPRTTHKKTQLGKLSLPAGVEVSLPILLVHHDKELWGEDANEFKPERFSEGVSKATKNQFTYFPFGGGPRICIGQNFAMMEAKLALSLILQHFTFELSPQYSHAPSVTITLQPQYGAHLILHKR

SEQ ID NO: 105 - DNA, 1578 bp, Artificial Sequence
  Codon-optimized KAH
atgggtttgttcccattagaggattcctacgcgctggtctttgaaggactagcaataacactggctttgtactatctactgtctttcatctacaaaacatctaaaaagacatgtacacctcctaaagcatctggtgaaatcattccaattacaggaatcatattgaatctgctatctggctcaagtggtctacctattatcttagcacttgcctctttagcagacagatgtggtcctattttcaccattaggctgggtattaggagagtgctagtagtatcaaattgggaaatcgctaaggagattttcactacccacgatttgatagtttctaatagaccaaaatacttagccgctaagattcttggtttcaattatgtttcattctctttcgctccatacggcccatattgggtcggaatcagaaagattattgctacaaaactaatgtcttcttccagacttcagaagttgcaatttgtaagagtttttgaactagaaaactctatgaaatctatcagagaatcatggaaggagaaaaaggatgaagagggaaaggtattagttgagatgaaaaagtggttctgggaactgaatatgaacatagtgttaaggacagttgctggtaaacaatacactggtacagttgatgatgccgatgcaaagcgtatctccgagttattcagagaatggtttcactacactggcagatttgtcgttggagacgcttttccttttctaggttggttggacctgggcggatacaaaaagacaatggaattagttgctagtagattggactcaatggtcagtaaatggttagatgagcatcgtaaaaagcaagctaacgatgacaaaaaggaggatatggatttcatggatatcatgatctccatgacagaagcaaattcaccacttgaaggatacggcactgatactattatcaagaccacatgtatgactttgattgtttcaggagttgatacaacctcaatcgtacttacttgggccttatcacttttgttaaacaacagagatactttgaaaaaggcacaagaggaattagatatgtgcgtaggtaaaggaagacaagtcaacgagtctgatcttgttaacttgatatacttggaagcagtgcttaaagaggctttaagactttacccagcagcgttcttaggcggaccaagagcattcttggaagattgtactgttgctggttatagaattccaaagggcacctgcttgttgattaacatgtggaaactgcatagagatccaaacatttggagtgatccttgcgaattcaagccagaaagatttttgacacctaatcaaaaggatgttgatgtgatcggtatggatttcgaattgataccatttggtgccggcagaagatattgtccaggtactagattggctttacagatgttgcatatcgtattagcgacattgctgcaaaacttcgaaatgtcaacaccaaacgatgcgccagtcgatatgactgcttctgttggcatgacaaatgccaaagcatcacctttagaagtcttgctatcacctcgtgttaaatggtcctaa

SEQ ID NO: 106 - protein, 522 aa, Stevia rebaudiana
MGLFPLEDSYALVFEGLAITLALYYLLSFIYKTSKKTCTPPKASGEHPITGHLNLLSGSSGLPHLALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 107 - DNA, 1431 bp, Artificial Sequence
  Codon-optimized KAH
atgatacaagttttaactccaattctactcttcctcatcttcttcgttttctggaaagtctacaaacatcaaaagactaaaatcaatctaccaccaggttccttcggctggccatttttgggtgaaaccttagccttacttagagcaggctgggattctgagccagaaagattcgtaagagagcgtatcaaaaagcatggatctccacttgttttcaagacatcactatttggagacagattcgctgttctttgcggtccagctggtaataagtttttgttctgcaacgaaaacaaattagtggcatcttggtggccagtccctgtaaggaagttgttcggtaaaagtttactcacaataagaggagatgaagcaaaatggatgagaaaaatgctattgtcttacttgggtccagatgcatttgccacacattatgccgttactatggatgttgtaacacgtagacatattgatgtccattggaggggcaaggaggaagttaatgtatttcaaacagttaagttgtacgcattcgaattagcttgtagattattcatgaacctagatgacccaaaccacatcgcgaaactcggtagtcttttcaacattttcctcaaagggatcatcgagcttcctatagacgttcctggaactagattttactccagtaaaaaggccgcagctgccattagaattgaattgaaaaagctcattaaagctagaaaactcgaattgaaggagggtaaggcgtcttcttcacaggacttgctttctcatctattaacatcacctgatgagaatgggatgttcttgacagaagaggaaatagtcgataacattctacttttgttattcgctggtcacgatacctctgcactatcaataacacttttgatgaaaaccttaggtgaacacagtgatgtgtacgacaaggttttgaaggaacaattagaaatttccaaaacaaaggaggcttgggaatcactaaagtgggaagatatccagaagatgaagtactcatggtcagtaatctgtgaagtcatgagattgaatcctcctgtcatagggacatacagagaggcgttggttgatatcgactatgctggttacactatcccaaaaggatggaagttgcattggtcagctgtttctactcaaagagacgaagccaatttcgaagatgtaactagattcgatccatccagatttgaaggggcaggccctactccattcacatttgtgcctttcggtggaggtcctagaatgtgtttaggcaaagagtttgccaggttagaagtgttagcatttctccacaacattgttaccaactttaagtgggatcttctaatccctgatgagaagatcgaatatgatccaatggctactccagctaagggcttgccaattagacttcatccacaccaagtctaa

SEQ ID NO: 108 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 109 - DNA, 1578 bp, Artificial Sequence
  Codon-optimized KAH
atggagtctttagtggttcatacagtaaatgctatctggtgtattgtaatcgtcgggattttctcagttggttatcacgtttacggtagagctgtggtcgaacaatggagaatgagaagatcactgaagctacaaggtgttaaaggcccaccaccatccatcttcaatggtaacgtctcagaaatgcaacgtatccaatccgaagctaaacactgctctggcgataacattatctcacatgattattcttcttcattattcccacacttcgatcactggagaaaacagtacggcagaatctacacatactctactggattaaagcaacacttgtacatcaatcatccagaaatggtgaaggagctatctcagactaacacattgaacttgggtagaatcacccatataaccaaaagattgaatcctatcttaggtaacggaatcataacctctaatggtcctcattgggcccatcagcgtagaattatcgcctacgagtttactcatgataagatcaagggtatggttggtttgatggttgagtctgctatgcctatgttgaataagtgggaggagatggtaaagagaggcggagaaatgggatgcgacataagagttgatgaggacttgaaagatgtttcagcagatgtgattgcaaaagcctgtttcggatcctcattttctaaaggtaaggctattttctctatgataagagatttgcttacagctatcacaaagagaagtgttctattcagattcaacggattcactgatatggtctttgggagtaaaaagcatggtgacgttgatatagacgctttagaaatggaattggaatcatccatttgggaaactgtcaaggaacgtgaaatagaatgtaaagatactcacaaaaaggatctgatgcaattgattttggaaggggcaatgcgttcatgtgacggtaacctttgggataaatcagcatatagaagatttgttgtagataattgtaaatctatctacttcgcagggcatgatagtacagctgtctcagtgtcatggtgtttgatgttactggccctaaacccatcatggcaagttaagatccgtgatgaaattctgtcttcttgcaaaaatggtattccagatgccgaaagtatcccaaaccttaaaacagtgactatggttattcaagagacaatgagattataccctccagcaccaatcgtcgggagagaagcctctaaagatatcagattgggcgatctagttgttcctaaaggcgtctgtatatggacactaataccagctttacacagagatcctgagatttggggaccagatgcaaacgatttcaaaccagaaagattttctgaaggaatttcaaaggcttgtaagtatcctcaaagttacattccatttggtctgggtcctagaacatgcgttggtaaaaactttggcatgatggaagtaaaggttcttgtttccctgattgtctccaagttctctttcactctatctcctacctaccaacatagtcctagtcacaaacttttagtagaaccacaacatggggtggtaattagagtggtttaa

SEQ ID NO: 110 - protein, 525 aa, Arabidopsis thaliana
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 111 - DNA, 1590 bp, Artificial Sequence
  Codon-optimized KAH
atgtacttcctactacaatacctcaacatcacaaccgttggtgtctttgccacattgtttctctcttattgtttacttctctggagaagtagagcgggtaacaaaaagattgccccagaagctgccgctgcatggcctattatcggccacctccacttacttgcaggtggatcccatcaactaccacatattacattgggtaacatggcagataagtacggtcctgtattcacaatcagaataggcttgcatagagctgtagttgtctcatcttgggaaatggcaaaggaatgttcaacagctaatgatcaagtgtcttcttcaagacctgaactattagcttctaagttgttgggttataactacgccatgtttggtttttcaccatacggttcatactggagagaaatgagaaagatcatctctctcgaattactatctaattccagattggaactattgaaagatgttagagcctcagaagttgtcacatctattaaggaactatacaaattgtgggcggaaaagaagaatgagtcaggattggtttctgtcgagatgaaacaatggttcggagatttgactttaaacgtgatcttgagaatggtggctggtaaaagatacttctccgcgagtgacgcttcagaaaacaaacaggcccagcgttgtagaagagtcttcagagaattcttccatctctccggcttgtttgtggttgctgatgctataccttttcttggatggctcgattggggaagacacgagaagaccttgaaaaagaccgccatagaaatggattccatcgcccaggagtggcttgaggaacatagacgtagaaaagattctggagatgataattctacccaagatttcatggacgttatgcaatctgtgctagatggcaaaaatctaggcggatacgatgctgatacgattaacaaggctacatgcttaactcttatatcaggtggcagtgatactactgtagtttctttgacatgggctcttagtcttgtgttaaacaatagagatactttgaaaaaggcacaggaagagttagacatccaagtcggtaaggaaagattggttaacgagcaagacatcagtaagttagtttacttgcaagcaatagtaaaagagacactcagactttatccaccaggtcctttgggtggtttgagacaattcactgaagattgtacactaggtggctatcacgtttcaaaaggaactagattaatcatgaacttatccaagattcaaaaagatccacgtatttggtctgatcctactgaattccaaccagagagattccttacgactcataaagatgtcgatccacgtggtaaacactttgaattcattccattcggtgcaggaagacgtgcatgtcctggtatcacattcggattacaagtactacatctaacattggcatctttcttgcatgcgtttgaattttcaacaccatcaaatgagcaggttaacatgagagaatcattaggtcttacgaatatgaaatctaccccattagaagttttgatttctccaagactatcccttaattgcttcaaccttatgaaaatttga

SEQ ID NO: 112 - protein, 526 aa, Vitis vinifera
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSSCSLYN

SEQ ID NO: 113 - DNA, 1440 bp, Artificial Sequence
  Codon-optimized KAH
atggaacctaacttttacttgtcattactattgttgttcgtgaccttcatttctttaagtctgtttttcatcttttacaaacaaaagtccccattgaatttgccaccagggaaaatgggttaccctatcataggtgaaagtttagaattcctatccacaggctggaagggacatcctgaaaagttcatatttgatagaatgcgtaagtacagtagtgagttattcaagacttctattgtaggcgaatccacagttgtttgctgtggggcagctagtaacaaattcctattctctaacgaaaacaaactggtaactgcctggtggccagattctgttaacaaaatcttcccaacaacttcactggattctaatttgaaggaggaatctataaagatgagaaagttgctgccacagttcttcaaaccagaagcacttcaaagatacgtcggcgttatggatgtaatcgcacaaagacattttgtcactcactgggacaacaaaaatgagatcacagtttatccacttgctaaaagatacactttcttgcttgcgtgtagactgttcatgtctgttgaggatgaaaatcatgtggcgaaattctcagacccattccaactaatcgctgcaggcatcatttcacttcctatcgatcttcctggtactccattcaacaaggccataaaggcttcaaatttcattagaaaagagctgataaagattatcaaacaaagacgtgttgatctggcagagggtacagcatctccaacccaggatatcttgtcacatatgctattaacatctgatgaaaacggtaaatctatgaacgagttgaacattgccgacaagattcttggactattgataggaggccacgatacagcttcagtagcttgcacatttctagtgaagtacttaggagaattaccacatatctacgataaagtctaccaagagcaaatggaaattgccaagtccaaacctgctggggaattgttgaattgggatgacttgaaaaagatgaagtattcatggaatgtggcatgtgaggtaatgagattgtcaccacctttacaaggtggttttagagaggctataactgactttatgtttaacggtttctctattccaaaagggtggaagttatactggtccgccaactctacacacaaaaatgcagaatgtttcccaatgcctgagaaattcgatcctaccagatttgaaggtaatggtccagcgccttatacatttgtaccattcggtggaggccctagaatgtgtcctggaaaggaatacgctagattagaaatcttggttttcatgcataatctggtcaaacgttttaagtgggaaaaggttattccagacgaaaagattattgtcgatccattcccaatcccagctaaagatcttccaatccgtttgtatcctcacaaagcttaa

SEQ ID NO: 114 - protein, 479 aa, Medicago truncatula
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 115 - DNA, 1116 bp, Artificial Sequence
  Codon-optimized GGPPS
atggcctctgttactttgggttcctggatcgtcgtccaccaccataaccatcaccatccatcatctatcctaactaaatctcgttcaagatcctgtcctattacactaaccaaaccaatctcttttcgttcaaagagaacagtttcctctagtagttctatcgtgtcctctagtgtcgtcactaaggaagacaatctgagacagtctgaaccttcttcctttgatttcatgtcatatatcattactaaggcagaactagtgaataaggctcttgattcagcagttccattaagagagccattgaaaatccatgaagcaatgagatactctcttctagctggcgggaagagagtcagacctgtactctgcatagcagcgtgcgaattagttggtggcgaggaatcaaccgctatgcctgccgcttgtgctgtagaaatgattcatacaatgtcactgatacacgatgatttgccatgtatggataacgatgatctgagaaggggtaagccaactaaccataaggttttcggcgaagatgttgccgtcttagctggtgatgctttgttatctttcgcgttcgaacatttggcatccgcaacatcaagtgatgttgtgtcaccagtaagagtagttagagcagttggagaactggctaaagctattggaactgagggtttagttgcaggtcaagtcgtcgatatctcttccgaaggtcttgatttgaatgatgtaggtcttgaacatctcgaattcatccatcttcacaagacagctgcacttttagaagccagtgcggttctcggcgcaattgttggcggagggagtgatgacgaaattgagagattgaggaagtttgctagatgtataggattactgttccaagtagtagacgatatactagatgtgacaaagtcttccaaagagttgggaaaaacagctggtaaagatttgattgccgacaaattgacctaccctaagattatggggctagaaaaatcaagagaatttgccgagaaactcaatagagaggcgcgtgatcaactgttgggtttcgattctgataaagttgcaccactcttagccttagccaactacatcgcttacagacaaaactaa

SEQ ID NO: 116 - protein, 371 aa, Arabidopsis thaliana
MASVTLGSWIVVHHHNHHHPSSILTKSRSRSCPITLTKPISFRSKRTVSSSSSIVSSSVVTKEDNLRQSEPSSFDFMSYIITKAELVNKALDSAVPLREPLKIHEAMRYSLLAGGKRVRPVLCIAACELVGGEESTAMPAACAVEMIHTMSLIHDDLPCMDNDDLRRGKPTNHKVFGEDVAVLAGDALLSFAFEHLASATSSDVVSPVRVVRAVGELAKAIGTEGLVAGQVVDISSEGLDLNDVGLEHLEFIHLHKTAALLEASAVLGAIVGGGSDDEIERLRKFARCIGLLFQVVDDILDVTKSSKELGKTAGKDLIADKLTYPKIMGLEKSREFAEKLNREARDQLLGFDSDKVAPLLALANYIAYRQN

SEQ ID NO: 117 - protein, 511 aa, Rubus suavissimus
MATLLEHFQAMPFAIPIALAALSWLFLFYIKVSFFSNKSAQAKLPPVPVVPGLPVIGNLLQLKEKKPYQTFTRWAEEYGPIYSIRTGASTMVVLNTTQVAKEAMVTRYLSISTRKLSNALKILTADKCMVAISDYNDFHKMIKRYILSNVLGPSAQKRHRSNRDTLRANVCSRLHSQVKNSPREAVNFRRVFEWELFGIALKQAFGKDIEKPIYVEELGTTLSRDEIFKVLVLDIMEGAIEVDWRDFFPYLRWIPNTRMETKIQRLYFRRKAVMTALINEQKKRIASGEEINCYIDFLLKEGKTLTMDQISMLLWETVIETADTTMVTTEWAMYEVAKDSKRQDRLYQEIQKVCGSEMVTEEYLSQLPYLNAVFHETLRKHSPAALVPLRYAHEDTQLGGYYIPAGTEIAINIYGCNMDKHQWESPEEWKPERFLDPKFDPMDLYKTMAFGAGKRVCAGSLQAMLIACPTIGRLVQEFEWKLRDGEEENVDTVGLTTHKRYPMHAILKPRS

SEQ ID NO: 118 - protein, 473 aa, Artificial Sequence
  UGT91D2e L211M
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 119 - protein, 473 aa, Artificial Sequence
  UGT91D2e L195G
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARGVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 120 - protein, 473 aa, Artificial Sequence
  UGT91D2e V196P
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLPPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 121 - protein, 473 aa, Artificial Sequence
  UGT91D2e L211H
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGHVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 122 - protein, 469 aa, Artificial Sequence
  UGT91D2e-b-EUGT11 chimera 2
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVPRNEEDGCLTKESVARSLRSVVVEKEGEIYKANARELSKIYNDTKVEKEYVSQFVDYLEKNARAVAIDHES

SEQ ID NO: 123 - protein, 473 aa, Artificial Sequence
  UGT91D2e L195C
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARCVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 124 - protein, 470 aa, Artificial Sequence
  UGT91D2e-b-EUGT11 chimera 4
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 125 - protein, 455 aa, Artificial Sequence
  UGT91D2e-b-EUGT11 chimera 5
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 126 - protein, 466 aa, Artificial Sequence
  UGT91D2e-b-EUGT11 chimera 6
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIARNDGDGSFDREGVAAAIRAVAVEEESSKVFQAKAKKLQEIVADMACHERYIDGFIQQLRSYKD

SEQ ID NO: 127 - protein, 481 aa, Artificial Sequence
  UGT85C2 T304S
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSSTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 128 - protein, 465 aa, Artificial Sequence
  UGT91D2e-b-EUGT11 chimera 8
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 129 - protein, 480 aa, Artificial Sequence
  UGT91D2e-b-EUGT11 chimera 9
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 130 - protein, 472 aa, Artificial Sequence
  UGT91D2e-b-EUGT11 chimera 10
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 131 - protein, 473 aa, Artificial Sequence
  UGT91D2e-b-EUGT11 chimera 11
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIARNDGDGSFDREGVAAAIRAVAVEEESSKVFQAKAKKLQEIVADMACHERYIDGFIQQLRSYKD

SEQ ID NO: 132 - protein, 463 aa, Artificial Sequence
  UGT91D2e-b-EUGT11 chimera 12
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 133 - protein, 462 aa, Artificial Sequence
  UGT91D2e-b-EUGT11 chimera 13
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVPRNEEDGCLTKESVARSLRSVVVEKEGEIYKANARELSKIYNDTKVEKEYVSQFVDYLEKNARAVAIDHES

SEQ ID NO: 134 - protein, 458 aa, Artificial Sequence
  UGT91D2e-b-EUGT11 chimera 14
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIARNDGDGSFDREGVAAAIRAVAVEEESSKVFQAKAKKLQEIVADMACHERYIDGFIQQLRSYKD

SEQ ID NO: 135 - DNA, 18 bp, Artificial Sequence
  Vector (forward)
ggcaagccacgtttggtg

SEQ ID NO: 136 - DNA, 20 bp, Artificial Sequence
  Vector (reverse)
ggagctgcatgtgtcagagg

SEQ ID NO: 137 - DNA, 37 bp, Artificial Sequence
  EUGT11 fragment 1 / UGT91D2e-b fragment 2 (forward)
cgatgtatttcatcactggttgccatccatcgcggct

SEQ ID NO: 138 - DNA, 37 bp, Artificial Sequence
  EUGT11 / UGT91D2e-b fragment 2 (reverse)
agccgcgatggatggcaaccagtgatgaaatacatcg

SEQ ID NO: 139 - DNA, 40 bp, Artificial Sequence
  UGT91D2e-b fragment 1 / EUGT11 fragment 2 (forward)
ttatgattatactcactactgggctgctgcagccgcattg

SEQ ID NO: 140 - DNA, 37 bp, Artificial Sequence; identical to SEQ ID NO: 138
  UGT91D2e-b fragment 1 / EUGT11 fragment 2 (reverse)

SEQ ID NO: 141 - DNA, 41 bp, Artificial Sequence
  EUGT11 fragment 2 / UGT91D2e-b fragment 3 (forward)
caaacctattactttccttggtttactgccaccggaaatac

SEQ ID NO: 142 - DNA, 41 bp, Artificial Sequence
  EUGT11 fragment 2 / UGT91D2e-b fragment 3 (reverse)
gtatttccggtggcagtaaaccaaggaaagtaataggtttg

SEQ ID NO: 143 - DNA, 38 bp, Artificial Sequence
  UGT91D2e-b fragment 2 / EUGT11 fragment 3 (forward)
ccggtggttccggtgggactaatgcctccattacatga

SEQ ID NO: 144 - DNA, 38 bp, Artificial Sequence
  UGT91D2e-b fragment 2 / EUGT11 fragment 3 (reverse)
tcatgtaatggaggcattagtcccaccggaaccaccgg

SEQ ID NO: 145 - DNA, 39 bp, Artificial Sequence
  EUGT11 fragment 3 / UGT91D2e-b fragment 4 (forward)
gaacgcaggtctgcaggttccaagaaatgaggaagatgg

SEQ ID NO: 146 - DNA, 39 bp, Artificial Sequence
  EUGT11 fragment 3 / UGT91D2e-b fragment 4 (reverse)
ccatcttcctcatttcttggaacctgcagacctgcgttc

SEQ ID NO: 147 - protein, 481 aa, Artificial Sequence
  UGT85C2 Q21L
MDAMATTEKKPHVIFIPFPALSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 148 - protein, 481 aa, Artificial Sequence
  UGT8C2 Q21T
MDAMATTEKKPHVIFIPFPATSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 149 - protein, 481 aa, Artificial Sequence
  UGT85C2 Q21V
MDAMATTEKKPHVIFIPFPAVSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 150 - protein, 481 aa, Artificial Sequence
  UGT85C2 F48S
MDAMATTEKKPHVIFIPFPAQSHIKAMLKLAQLLHHKGLQITFVNTDSIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 151 - protein, 481 aa, Artificial Sequence
  UGT85C2 F48H
MDAMATTEKKPHVIFIPFPAQSHIKAMLKLAQLLHHKGLQITFVNTDHIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 152 - protein, 481 aa, Artificial Sequence
  UGT85C2 F48Y
MDAMATTEKKPHVIFIPFPAQSHIKAMLKLAQLLHHKGLQITFVNTDYIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 153 - protein, 481 aa, Artificial Sequence
  UGT85C2 F48R
MDAMATTEKKPHVIFIPFPAQSHIKAMLKLAQLLHHKGLQITFVNTDRIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 154 - protein, 481 aa, Artificial Sequence
  UGT85C2 F48Q
MDAMATTEKKPHVIFIPFPAQSHIKAMLKLAQLLHHKGLQITFVNTDQIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 155 - protein, 481 aa, Artificial Sequence
  UGT85C2 F48W
MDAMATTEKKPHVIFIPFPAQSHIKAMLKLAQLLHHKGLQITFVNTDWIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 156 - protein, 481 aa, Artificial Sequence
  UGT85C2 F48T
MDAMATTEKKPHVIFIPFPAQSHIKAMLKLAQLLHHKGLQITFVNTDTIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 157 - protein, 481 aa, Artificial Sequence
  UGT85C2 I49V
MDAMATTEKKPHVIFIPFPAQSHIKAMLKLAQLLHHKGLQITFVNTDFVHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 158 - protein, 481 aa, Artificial Sequence
  UGT85C2 S84G
MDAMATTEKKPHVIFIPFPAQSHIKAMLKLAQLLHHKGLQITFVNTDFIHNQFLESSGPHCLDGAPGFRFETIPDGVSHSPEAGIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 159 - protein, 481 aa, Artificial Sequence
  UGT85C2 S84A
MDAMATTEKKPHVIFIPFPAQSHIKAMLKLAQLLHHKGLQITFVNTDFIHNQFLESSGPHCLDGAPGFRFETIPDGVSHSPEAAIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 160 - protein, 481 aa, Artificial Sequence
  UGT85C2 S84T
MDAMATTEKKPHVIFIPFPAQSHIKAMLKLAQLLHHKGLQITFVNTDFIHNQFLESSGPHCLDGAPGFRFETIPDGVSHSPEATIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 161 - protein, 481 aa, Artificial Sequence
  UGT85C2 S84C
MDAMATTEKKPHVIFIPFPAQSHIKAMLKLAQLLHHKGLQITFVNTDFIHNQFLESSGPHCLDGAPGFRFETIPDGVSHSPEACIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 162 - protein, 481 aa, Artificial Sequence
  UGT85C2 S84P
MDAMATTEKKPHVIFIPFPAQSHIKAMLKLAQLLHHKGLQITFVNTDFIHNQFLESSGPHCLDGAPGFRFETIPDGVSHSPEAPIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 163 - protein, 481 aa, Artificial Sequence
  UGT85C2 S84N
MDAMATTEKKPHVIFIPFPAQSHIKAMLKLAQLLHHKGLQITFVNTDFIHNQFLESSGPHCLDGAPGFRFETIPDGVSHSPEANIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 164 - protein, 481 aa, Artificial Sequence
  UGT85C2 S84V
MDAMATTEKKPHVIFIPFPAQSHIKAMLKLAQLLHHKGLQITFVNTDFIHNQFLESSGPHCLDGAPGFRFETIPDGVSHSPEAVIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 165 - protein, 481 aa, Artificial Sequence
  UGT85C2 P86R
MDAMATTEKKPHVIFIPFPAQSHIKAMLKLAQLLHHKGLQITFVNTDFIHNQFLESSGPHCLDGAPGFRFETIPDGVSHSPEASIRIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 166 - protein, 481 aa, Artificial Sequence
  UGT85C2 P86G
MDAMATTEKKPHVIFIPFPAQSHIKAMLKLAQLLHHKGLQITFVNTDFIHNQFLESSGPHCLDGAPGFRFETIPDGVSHSPEASIGIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 167 - protein, 481 aa, Artificial Sequence
  UGT85C2 I87H
MDAMATTEKKPHVIFIPFPAQSHIKAMLKLAQLLHHKGLQITFVNTDFIHNQFLESSGPHCLDGAPGFRFETIPDGVSHSPEASIPHRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 168 - protein, 481 aa, Artificial Sequence
  UGT85C2 I87P
MDAMATTEKKPHVIFIPFPAQSHIKAMLKLAQLLHHKGLQITFVNTDFIHNQFLESSGPHCLDGAPGFRFETIPDGVSHSPEASIPPRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 169 - protein, 481 aa, Artificial Sequence
  UGT85C2 I87M
MDAMATTEKKPHVIFIPFPAQSHIKAMLKLAQLLHHKGLQITFVNTDFIHNQFLESSGPHCLDGAPGFRFETIPDGVSHSPEASIPMRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 170 - protein, 481 aa, Artificial Sequence
  UGT85C2 I87Y
MDAMATTEKKPHVIFIPFPAQSHIKAMLKLAQLLHHKGLQITFVNTDFIHNQFLESSGPHCLDGAPGFRFETIPDGVSHSPEASIPYRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 171 - protein, 481 aa, Artificial Sequence
  UGT85C2 L91K
MDAMATTEKKPHVIFIPFPAQSHIKAMLKLAQLLHHKGLQITFVNTDFIHNQFLESSGPHCLDGAPGFRFETIPDGVSHSPEASIPIRESKLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 172 - protein, 481 aa, Artificial Sequence
  UGT85C2 L91R
MDAMATTEKKPHVIFIPFPAQSHIKAMLKLAQLLHHKGLQITFVNTDFIHNQFLESSGPHCLDGAPGFRFETIPDGVSHSPEASIPIRESRLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 173 - protein, 481 aa, Artificial Sequence
  UGT85C2 L91T
MDAMATTEKKPHVIFIPFPAQSHIKAMLKLAQLLHHKGLQITFVNTDFIHNQFLESSGPHCLDGAPGFRFETIPDGVSHSPEASIPIRESTLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 174 - protein, 481 aa, Artificial Sequence
  UGT85C2 L92F
MDAMATTEKKPHVIFIPFPAQSHIKAMLKLAQLLHHKGLQITFVNTDFIHNQFLESSGPHCLDGAPGFRFETIPDGVSHSPEASIPIRESLFRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 175 - protein, 481 aa, Artificial Sequence
  UGT85C2 L92I
MDAMATTEKKPHVIFIPFPAQSHIKAMLKLAQLLHHKGLQITFVNTDFIHNQFLESSGPHCLDGAPGFRFETIPDGVSHSPEASIPIRESLIRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 176 - protein, 481 aa, Artificial Sequence
  UGT85C2 L92M
MDAMATTEKKPHVIFIPFPAQSHIKAMLKLAQLLHHKGLQITFVNTDFIHNQFLESSGPHCLDGAPGFRFETIPDGVSHSPEASIPIRESLMRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 177 - protein, 481 aa, Artificial Sequence
  UGT85C2 I95K
MDAMATTEKKPHVIFIPFPAQSHIKAMLKLAQLLHHKGLQITFVNTDFIHNQFLESSGPHCLDGAPGFRFETIPDGVSHSPEASIPIRESLLRSKETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 178 - protein, 481 aa, Artificial Sequence
  UGT85C2 F122S
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGSLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 179 - protein, 481 aa, Artificial Sequence
  UGT85C2 L334S
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNSVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 180 - protein, 481 aa, Artificial Sequence
  UGT85C2 L334M
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNMVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 181 - protein, 458 aa, Artificial Sequence
  UGT76G1 Q23H
MENKTETTVRRRRRIILFPVPFHGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 182 - protein, 458 aa, Artificial Sequence
  UGT76G1 I26W
MENKTETTVRRRRRIILFPVPFQGHWNPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 183 - protein, 458 aa, Artificial Sequence
  UGT76G1 T146G
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMGSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 184 - protein, 458 aa, Artificial Sequence
  UGT76G1 H155L
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 185 - protein, 458 aa, Artificial Sequence
  UGT76G1 L257G
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSGLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 186 - protein, 458 aa, Artificial Sequence
  UGT76G1 S253W
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTAWSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 187 - protein, 458 aa, Artificial Sequence
  UGT76G1 T284G
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSGSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 188 - protein, 458 aa, Artificial Sequence
  UGT76G1 S283N
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGNTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 189 - protein, 458 aa, Artificial Sequence
  UGT76G1 K337P
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVPWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 190 - protein, 458 aa, Artificial Sequence
  UGT76G1 T55K
MENKTETTVRRRRRIILFPVPFQGHINPILQLANVLYSKGFSITIFHTNFNKPKKSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 191 - protein, 473 aa, Artificial Sequence
  UGT91D2e L213E
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVEKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 192 - protein, 473 aa, Artificial Sequence
  UGT91D2e S221Y
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLYKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 193 - protein, 473 aa, Artificial Sequence
  UGT91D2e E438H
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARHLSKIYNDTKVEKEYVSQFVDYLEKNARAVAIDHES

SEQ ID NO: 194 - protein, 473 aa, Artificial Sequence
  UGT91D2e M152T
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYTGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 195 - protein, 473 aa, Artificial Sequence
  UGT91D2e L211C
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGCVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 196 - protein, 473 aa, Artificial Sequence
  UGT91D2e L195S
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARSVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 197 - protein, 473 aa, Artificial Sequence
  UGT91D2e L195V
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARVVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 198 - protein, 473 aa, Artificial Sequence
  UGT91D2e V286S
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSESLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 199 - protein, 473 aa, Artificial Sequence; identical to SEQ ID NO: 11
  UGT91D2e S221S

SEQ ID NO: 200 - protein, 473 aa, Artificial Sequence
  UGT91D2e P93V M152G
MATSDSIVDDRKQLHVATFPWLAFGHILPYLQLSKLIAEKGHKVSFLSTTRNIQRLSSHISPLINVVQLTLPRVQELPEDAEATTDVHPEDIVYLKKASDGLQPEVTRFLEQHSPDWIIYDYTHYWLPSIAASLGISRAHFSVTTPWAIAYGGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 201 - protein, 473 aa, Artificial Sequence
  UGT91D2e S99I
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKAIDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 202 - protein, 473 aa, Artificial Sequence
  UGT91D2e T144K P201P
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVKTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 203 - protein, 473 aa, Artificial Sequence
  UGT91D2e T144L
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVLTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 204 - protein, 473 aa, Artificial Sequence
  UGT91D2e T144M
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVMTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 205 - protein, 473 aa, Artificial Sequence
  UGT91D2e A148K L211I
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWKIAYMGPSADAMINGSDGRTTVEDLTTPPKWFPFPTKVCWRKHDLARLVPYKAPGISDGYRMGIVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 206 - protein, 473 aa, Artificial Sequence
  UGT91D2e L195N
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARNVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 207 - protein, 473 aa, Artificial Sequence
  UGT91D2e K199C
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYCAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 208 - protein, 473 aa, Artificial Sequence
  UGT91D2e L211M E426G A466V
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVGKEGEIYKANARELSKIYNDTKVEKEYVSQFVDYLEKNARVVAIDHES

SEQ ID NO: 209 - protein, 473 aa, Artificial Sequence
  UGT91D2e L211T I303I
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGTVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 210 - protein, 473 aa, Artificial Sequence
  UGT91D2e V286N
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSENLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 211 - protein, 473 aa, Artificial Sequence
  UGT91D2e S114F V286S
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHFPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSESLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 212 - protein, 473 aa, Artificial Sequence
  UGT91D2e G384K
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFKDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 213 - protein, 473 aa, Artificial Sequence
  UGT91D2e G384Y
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFYDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 214 - protein, 473 aa, Artificial Sequence
  UGT91D2e E438M
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARMLSKIYNDTKVEKEYVSQFVDYLEKNARAVAIDHES

SEQ ID NO: 215 - DNA, 35 bp, Artificial Sequence
  Forward USER primer
atcaacggguaaaatggatgctatggctaccaccg

SEQ ID NO: 216 - DNA, 33 bp, Artificial Sequence
  Reverse USER primer
cgtgcgautcagtttctggccaaaacggtgatt

SEQ ID NO: 217 - protein, 458 aa, Artificial Sequence
  UGT76G1 Q23H H155L
MENKTETTVRRRRRIILFPVPFHGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 218 - protein, 458 aa, Artificial Sequence
  UGT76G1 T146G H155L
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMGSSLFNFHALVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 219 - protein, 458 aa, Artificial Sequence
  UGT76G1 L257G H155L
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSGLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 220 - protein, 458 aa, Artificial Sequence
  UGT76G1 S283N H155L
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHALVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGNTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

What is claimed is:

1. A recombinant host cell capable of producing a steviol glycoside, a glycosylated ent-kaurenol compound, and/or a glycosylated ent-kaurenoic acid compound in a cell culture, comprising a gene encoding a polypeptide capable of selectively converting rubusoside to stevioside and having 95% or greater sequence identity to the amino acid sequence set forth in SEQ ID NO:17 or 18 and a first gene encoding a first polypeptide capable of beta 1,2 glycosylation of the C2' of the 13-O-glucose, 19-O-glucose, or both 13-O-glucose and 19-O-glucose of the steviol glycoside and having 95% or greater sequence identity to the amino acid sequence set forth in SEQ ID NO:16; wherein the recombinant host cell further comprises one or more of:
   (a) a second gene encoding a second polypeptide capable of beta 1,2 glycosylation of the C2' of the 13-O-glucose, 19-O-glucose, or both 13-O-glucose and 19-O-glucose of the steviol glycoside,
      having 95% or greater sequence identity to the amino acid sequence set forth in SEQ ID NO:11;
   (b) a gene encoding a polypeptide capable of glycosylating steviol or the steviol glycoside at its C-13 hydroxyl group
      having 95% or greater sequence identity to the amino acid sequence set forth in SEQ ID NO:7; and
   (c) a gene encoding a polypeptide capable of beta 1,3 glycosylation of the C3' of the 13-O-glucose, 19-O-glucose, or both 13-O-glucose and 19-O-glucose of the steviol glycoside
      having 95% or greater sequence identity to the amino acid sequence set forth in SEQ ID NO:9; or
   (d) a gene encoding a polypeptide capable of glycosylating steviol or a steviol glycoside at its C-19 carboxyl group, wherein the polypeptide comprises a polypeptide having 95% or greater sequence identity to the amino acid sequence set forth in SEQ ID NO:4;
   wherein at least one of the genes is a recombinant gene.

2. The recombinant host cell of claim 1, wherein the second polypeptide capable of beta 1,2 glycosylation of the C2' of the 13-O-glucose, 19-O-glucose, or both 13-O-glucose and 19-O-glucose of the steviol glycoside comprises a polypeptide having one or more amino acid substitutions of residues 93, 99, 114, 144, 148, 152, 195, 196, 199, 211, 213, 221, 286, 384, 426, 438, or 466 of SEQ ID NO:11 or at least one amino acid substitution of SEQ ID NO:11 that is P93V, S99I, S114F, T144K, T144L, T144M, A148K, M152T, L195G, L195C, L195S, L195N, L195V, V196P, K199C, L211H, L211M, L211I, L211C, L211T, L213E, S221I, V286C, V286N, V286S, G384W, G384K, G384Y, E426G, E438H, E438M, or A466V.

3. The recombinant host cell of claim 1, wherein the polypeptide capable of glycosylating steviol or the steviol glycoside at its C-13 hydroxyl group comprises a polypeptide having one or more amino acid substitutions of residues 21, 48, 49, 84, 86, 87, 91, 92, 95, 122, or 334 of SEQ ID NO:7 or at least one amino acid substitution of SEQ ID NO:7 that is Q21L, Q21T, Q21V, F48S, F48H, F48Y, F48R, F48Q, F48W, F48T, 149V, S84G, S84A, S84T, S84C, S84P, S84N, S84V, P86R, P86G, 187H, 187P, 187M, 187Y, L91K, L91R, L91T, L92F, L92I, L92M, 195K, F122S, L334S, or L334M.

4. The recombinant host cell of claim 1, wherein the polypeptide capable of beta 1,3 glycosylation of the C3' of the 13-O-glucose, 19-O-glucose, or both 13-O-glucose and 19-O-glucose of the steviol glycoside comprises a polypeptide having one or more amino acid substitutions of residues 23, 26, 55, 146, 257, 283, and 337 of SEQ ID NO:9 or at least one amino acid substitution of SEQ ID NO:9 that is Q23H, I26W, T146G, H155L, L257G, S253W, T284G, S283N, K337P, or T55K.

5. The recombinant host cell of claim 1, further comprising:
   (a) a gene encoding a polypeptide capable of synthesizing geranylgeranyl pyrophosphate (GGPP) from farnesyl diphosphate (FPP) and isopentenyl diphosphate (IPP)
      having 95% or greater sequence identity to the amino acid sequence set forth in any one of SEQ ID NOs:20, 22, 24, 26, 28, 30, 32, or 116;
   (b) a gene encoding a polypeptide capable of synthesizing ent-copalyl diphosphate from GGPP,
      having 95% or greater sequence identity to the amino acid sequence set forth in any one of SEQ ID NOs:34, 36, 38, 40, or 42;
   (c) a gene encoding a polypeptide capable of synthesizing ent-kaurene from ent-copalyl diphosphate
      having 95% or greater sequence identity to the amino acid sequence set forth in any one of SEQ ID NOs:44, 46, 48, 50, or 52;
   (d) a gene encoding a polypeptide capable of synthesizing ent-kaurenoic acid from ent-kaurene
      having 95% or greater sequence identity to the amino acid sequence set forth in any one of SEQ ID NOs:60, 62, 66, 68, 70, 72, 74, 76, or 117;
   (e) a gene encoding a polypeptide capable of reducing cytochrome P450 complex
      having 95% or greater sequence identity to the amino acid sequence set forth in any one of SEQ ID NOs:78, 80, 82, 84, 86, 88, 90, 92; and (f) a gene encoding a polypeptide capable of synthesizing steviol from ent-kaurenoic acid
having 95% or greater sequence identity to the amino acid sequence set forth in any one of SEQ ID NOs:94, 97, 100-104, 106, 108, 110, 112, or 114;
wherein at least one of the genes is a recombinant gene.

6. The recombinant host cell of claim 1, wherein the cell culture comprises:
(a) the steviol glycoside, the glycosylated ent-kaurenol compound, and/or the glycosylated ent-kaurenoic acid compound produced by the recombinant host cell,
(b) glucose, fructose, sucrose, xylose, rhamnose, UDP-glucose, UDP-rhamnose, UDP-xylose, and/or N-acetyl-glucosamine; and
(c) supplemental nutrients comprising trace metals, vitamins, salts, yeast nitrogen base (YNB), and/or amino acids.

7. The recombinant host cell of claim 1, wherein the recombinant host is a plant cell, a mammalian cell, an insect cell, a fungal cell, an algal cell, or a bacterial cell.

8. The recombinant host cell of claim 7, wherein the bacterial cell is an *Escherichia* bacteria cell, a *Lactobacillus* bacteria cell, a *Lactococcus* bacteria cell, a *Cornebacterium* bacteria cell, an *Acetobacter* bacteria cell, an *Acinetobacter* bacteria cell, or a *Pseudomonas* bacterial cells.

9. The recombinant host cell of claim 7, wherein the fungal cell comprises a yeast cell.

10. The recombinant host cell of claim 9, wherein the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous,* or *Candida albicans* species.

11. The recombinant host cell of claim 10, wherein the yeast cell is a Saccharomycete.

12. The recombinant host cell of claim 11, wherein the yeast cell is a cell from the *Saccharomyces cerevisiae* species.

13. A method of producing a steviol glycoside, a glycosylated ent-kaurenol compound, and/or a glycosylated ent-kaurenoic acid compound in a cell culture, comprising culturing the recombinant host cell of claim 1 in the cell culture, under conditions in which the genes are expressed; and
wherein the steviol glycoside, the glycosylated ent-kaurenol compound, and/or the glycosylated ent-kaurenoic acid compound is produced by the recombinant host cell.

14. The method of claim 13, wherein the genes are constitutively expressed.

15. The method of claim 13, wherein the recombinant host cell is grown in a fermentor at a temperature for a period of time, wherein the temperature and the period of time facilitate the production of the steviol glycoside, the glycosylated ent-kaurenol compound, and/or the glycosylated ent-kaurenoic acid compound.

16. The method of claim 13, further comprising isolating the steviol glycoside, the glycosylated ent-kaurenol compound, and/or the glycosylated ent-kaurenoic acid compound, alone or in combination from the cell culture.

17. The method of claim 16, wherein the isolating step comprises separating a liquid phase of the cell culture from a solid phase of the cell culture to obtain a supernatant comprising the produced steviol glycoside, the glycosylated ent-kaurenol compound, and/or the glycosylated ent-kaurenoic acid compound, and:
(a) contacting the supernatant with one or more adsorbent resins in order to obtain at least a portion of the produced steviol glycoside, the glycosylated ent-kaurenol compound, and/or the glycosylated ent-kaurenoic acid compound; or
(b) contacting the supernatant with one or more ion exchange or reversed-phase chromatography columns in order to obtain at least a portion of the produced steviol glycoside, the glycosylated ent-kaurenol compound, and/or the glycosylated ent-kaurenoic acid compound; or
(c) crystallizing or extracting the produced steviol glycoside, the glycosylated ent-kaurenol compound, and/or the glycosylated ent-kaurenoic acid compound;
thereby isolating the produced steviol glycoside, the glycosylated ent-kaurenol compound, and/or the glycosylated ent-kaurenoic acid compound.

18. The method of claim 13, further comprising recovering the steviol glycoside, the glycosylated ent-kaurenol compound, and/or the glycosylated ent-kaurenoic acid compound alone or in combination from the cell culture.

19. The method of claim 18, wherein the recovered steviol glycoside, the glycosylated ent-kaurenol compound, and/or the glycosylated ent-kaurenoic acid compound or a combination thereof is enriched for the steviol glycoside, the glycosylated ent-kaurenol compound, and/or the glycosylated ent-kaurenoic acid compound relative to a steviol glycoside composition of *Stevia* plant and has a reduced level of *Stevia* plant-derived components relative to a steviol glycoside composition obtained from a plant-derived *Stevia* extract.

20. The method of claim 13, wherein the cell culture comprises:
(a) the steviol glycoside, the glycosylated ent-kaurenol compound, and/or the glycosylated ent-kaurenoic acid compound produced by the recombinant host cell,
(b) glucose, fructose, sucrose, xylose, rhamnose, UDP-glucose, UDP-rhamnose, UDP-xylose, and/or N-acetyl-glucosamine; and
(c) supplemental nutrients comprising trace metals, vitamins, salts, YNB, and/or amino acids.

21. The method of claim 13, wherein the recombinant host cell is a plant cell, a mammalian cell, an insect cell, a fungal cell, an algal cell, or a bacterial cell.

22. The method of claim 21, wherein the bacterial cell comprises *Escherichia* bacteria cells, *Lactobacillus* bacteria cells, *Lactococcus* bacteria cells, *Cornebacterium* bacteria cells, *Acetobacter* bacteria cells, *Acinetobacter* bacteria cells, or *Pseudomonas* bacterial cells.

23. The method of claim 21, wherein the fungal cell comprises a yeast cell.

24. The method of claim 23, wherein the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous,* or *Candida albicans* species.

25. The method of claim 23, wherein the yeast cell is a Saccharomycete.

26. The method of claim 25, wherein the yeast cell is a cell from the *Saccharomyces cerevisiae* species.

27. The recombinant host cell of claim 1, wherein:
(a) the steviol glycoside comprises steviol-13-O-glucoside (13-SMG), steviol-19-O-glucoside (19-SMG), steviol-1,2-bioside, steviol-1,3-bioside, 1,2-stevioside, 1,3-stevioside, rubusoside, Rebaudioside A (RebA), Rebaudioside B (RebB), Rebaudioside D (RebD), Rebaudioside E (RebE), Rebaudioside M (RebM), a di-glycosylated steviol, a tri-glycosylated steviol, a tetra-glycosylated steviol, a penta-glycosylated steviol, a hexa-glycosylated steviol, a hepta-glycosylated steviol, and/or isomers thereof;
(b) the glycosylated ent-kaurenol compound comprises di-glycosylated ent-kaurenol, tri-glycosylated ent-kaurenol, and/or isomers thereof; and
(c) the glycosylated ent-kaurenoic acid compound comprises di-glycosylated ent-kaurenoic acid, tri-glycosylated ent-kaurenoic acid, and/or isomers thereof.

28. The recombinant host cell of claim 27, wherein:
(a) the di-glycosylated steviol comprises compound 2.23 of Table 1;
(b) the tri-glycosylated steviol comprises compound 3.1 and/or compound 3.34 of Table 1;
(c) the tetra-glycosylated steviol comprises compound 4.26 and/or compound 4.33 of Table 1;
(d) the penta-glycosylated steviol comprises compound 5.22, compound 5.24, and/or compound 5.25 of Table 1;
(e) the hexa-glycosylated steviol comprises compound 6.1 and/or compound 6.23 of Table 1;
(f) the hepta-glycosylated steviol comprises compound 7.2, compound 7.5, and/or compound 7.13 of Table 1;
(g) the glycosylated ent-kaurenoic acid compound comprises compound KA3.1, compound KA3.2, and/or compound KA2.7 of Table 1; and
(h) the glycosylated ent-kaurenol compound comprises compound KL2.8 and/or compound KL3.1 co-eluted with compound KL3.6 of Table 1.

29. The recombinant host cell of claim 28, wherein:
(a) compound 4.26 has the structure:

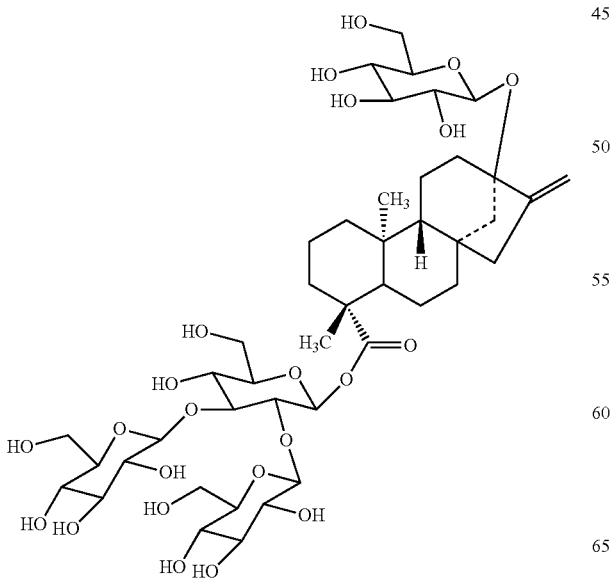

(b) compound 5.22 has the structure:

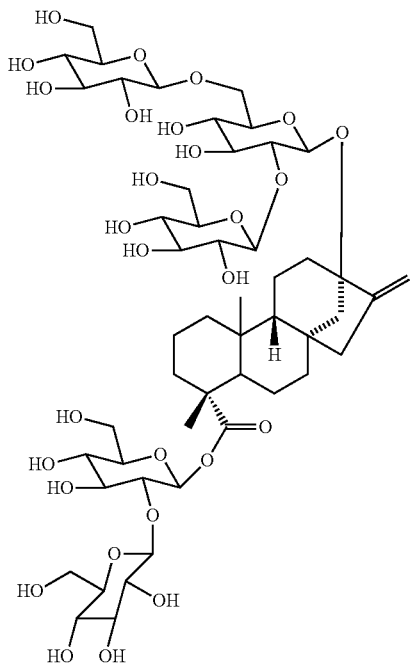

(c) compound 6.1 has the structure:

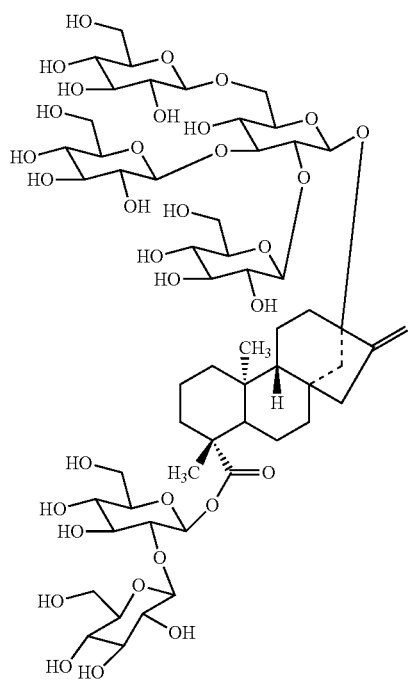

(d) compound 7.2 has the structure:
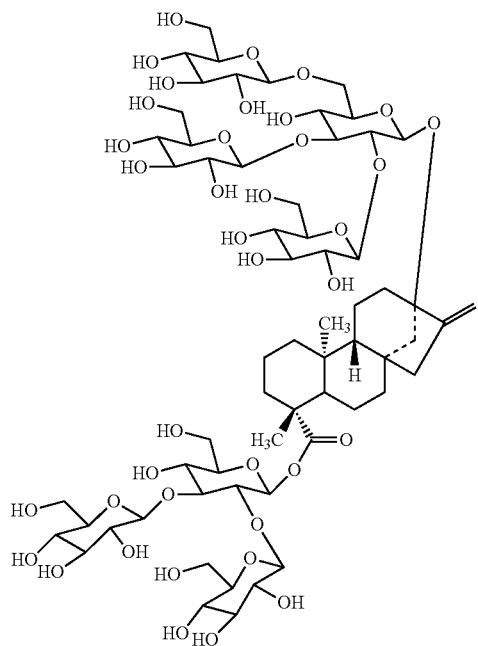
(e) compound 7.5 has the structure:
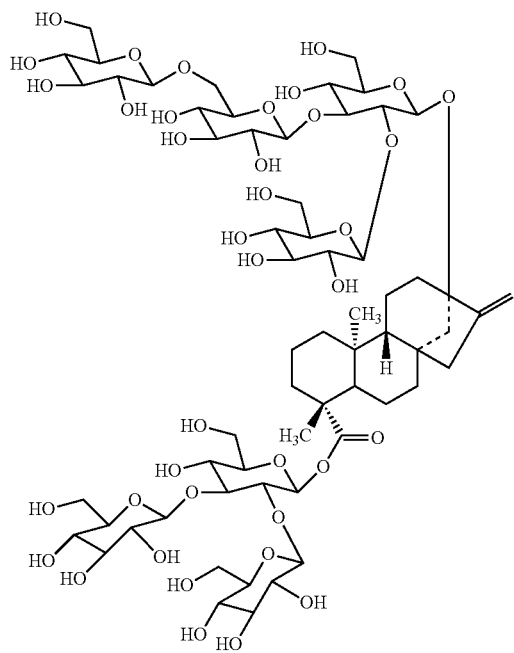
(f) compound KA3.1 has the structure:
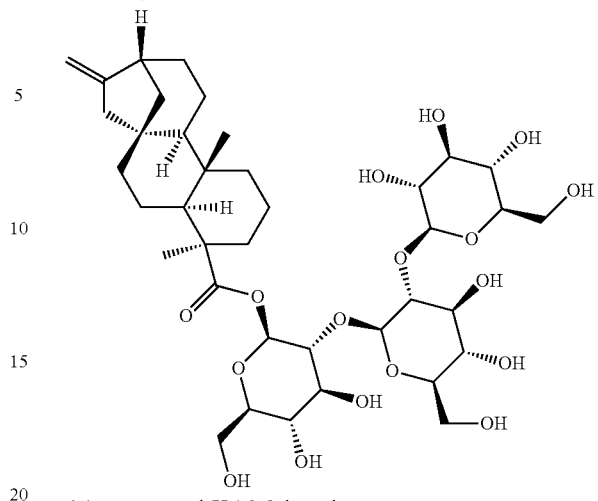
(g) compound KA3.2 has the structure:
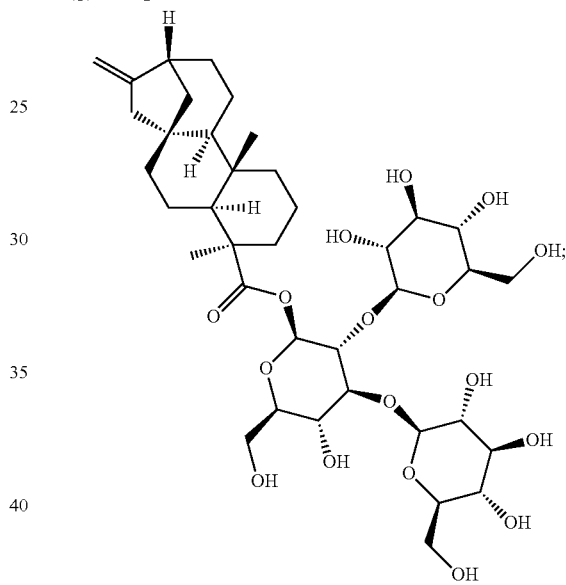
and
(h) compound KL3.1 has the structure:
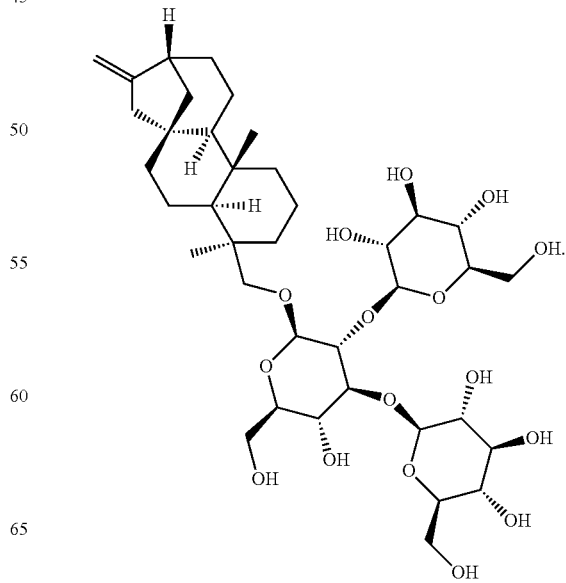

30. A cell culture, comprising the recombinant host cell of claim 1, the cell culture further comprising:
  (a) the steviol glycoside, the glycosylated ent-kaurenol compound, and/or the glycosylated ent-kaurenoic acid compound produced by the recombinant host cell;
  (b) glucose, fructose, sucrose, xylose, rhamnose, UDP-glucose, UDP-rhamnose, UDP-xylose, and/or N-acetyl-glucosamine; and
  (c) supplemental nutrients comprising trace metals, vitamins, salts, YNB, and/or amino acids;
  wherein the steviol glycoside, the glycosylated ent-kaurenol compound, and/or the glycosylated ent-kaurenoic acid compound are present at a concentration of at least 1 mg/liter of the cell culture;
  wherein the cell culture is enriched for the steviol glycoside, the glycosylated ent-kaurenol compound, and/or the glycosylated ent-kaurenoic acid compound relative to a steviol glycoside composition from a *Stevia* plant and has a reduced level of *Stevia* plant-derived components relative to a plant-derived *Stevia* extract.

31. A cell lysate from the recombinant host cell of claim 1 grown in the cell culture, comprising:
  (a) the steviol glycoside, the glycosylated ent-kaurenol compound, and/or the glycosylated ent-kaurenoic acid compound produced by the recombinant host cell;
  (b) glucose, fructose, sucrose, xylose, rhamnose, UDP-glucose, UDP-rhamnose, UDP-xylose, and/or N-acetyl-glucosamine; and
  (c) supplemental nutrients comprising trace metals, vitamins, salts, yeast nitrogen base, YNB, and/or amino acids;
  wherein the steviol glycoside, the glycosylated ent-kaurenol compound, and/or the glycosylated ent-kaurenoic acid compound produced by the recombinant host cell is present at a concentration of at least 1 mg/liter of the cell culture.

32. The recombinant host cell of claim 1, wherein the recombinant host cell is a *Yarrowia lipolytica* cell.

33. The method of claim 13, wherein the expression of the genes is induced.

34. The recombinant host cell of claim 1, wherein the total amount of the steviol glycoside, the glycosylated ent-kaurenol compound, and/or the glycosylated ent-kaurenoic acid compound produced by the recombinant host cell is by at least about 5%, at least about 10%, at least about 25%, at least about 50%, at least about 75%, or at least about 100% relative to a corresponding host lacking the one or more recombinant genes.

35. The recombinant host cell of claim 1, wherein expression of the one or more recombinant genes increases the amount of the steviol glycoside, the glycosylated ent-kaurenol compound, and/or the glycosylated ent-kaurenoic acid, accumulated by the cell by at least about 5%, at least about 10%, at least about 25%, at least about 50%, at least about 75%, or at least about 100% relative to a corresponding host lacking the one or more recombinant genes.

36. The recombinant host cell of claim 1, wherein expression of the one or more recombinant genes decreases the amount of the steviol glycoside, the glycosylated ent-kaurenol compound, and/or the glycosylated ent-kaurenoic acid, accumulated by the cell by at least about 5%, at least about 10%, at least about 25%, at least about 50%, at least about 75%, or at least about 100% relative to a corresponding host lacking the one or more recombinant genes.

* * * * *